United States Patent 7,745,391 (HUMAN THROMBOSPONDIN POLYPEPTIDE) - sequence listing, part 265

SEQ ID NO: 751388 - protein, 588 aa, Homo sapiens
PGWYRPDEGILGEIVEAWRGSDVFHNSVLQGATSGPTAFKQQRSTRIVGANSRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 751389 - protein, 452 aa, Homo sapiens
MRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRTE

SEQ ID NO: 751390 - protein, 488 aa, Homo sapiens [sequence omitted]

SEQ ID NO: 751391 - protein, 109 aa, Homo sapiens
MSHNSCALPLPSTEILSLRHKATAMGWGQVASATQDCLPYPLHCLFQQYEVKIRTTQAGGAAKTLVSLALPTASIARSSSLIYILQIYPQEDRWNHSFLLNSRTLRKLT

SEQ ID NO: 751392 - protein, 140 aa, Homo sapiens
RSQNIAPGTRLGVAGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751393 - protein, 125 aa, Homo sapiens
MKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751394 - protein, 125 aa, Homo sapiens; identical to SEQ ID NO: 751393

SEQ ID NO: 751395 - protein, 125 aa, Homo sapiens; identical to SEQ ID NO: 751393

SEQ ID NO: 751396 - protein, 208 aa, Homo sapiens
KDELKKSLYAIFSQFGQILDILVSRSLKMRGQAFVIFKEVSSATNALRSMQGFPFYDKPMRIQYAKTDSDIISRCGLPRVTAGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751397 - protein, 125 aa, Homo sapiens; identical to SEQ ID NO: 751393

SEQ ID NO: 751398 - protein, 125 aa, Homo sapiens; identical to SEQ ID NO: 751393

SEQ ID NO: 751399 - protein, 125 aa, Homo sapiens; identical to SEQ ID NO: 751393

SEQ ID NO: 751400 - protein, 84 aa, Homo sapiens
KDELKKSLYAIFSQFGQILDILVSRSLKMRGQAFVIFKEVSSATNALRSMQGFPFYDKPMRIQYAKTDSDIIHVAAFLASQPGW

SEQ ID NO: 751401 - protein, 143 aa, Homo sapiens
MARYEAWVKFGRGSLQLGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751402 - protein, 131 aa, Homo sapiens
SSRFNRTKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751403 - protein, 141 aa, Homo sapiens
MLVRPGVISSIHALRGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751404 - protein, 125 aa, Homo sapiens; identical to SEQ ID NO: 751393

SEQ ID NO: 751405 - protein, 125 aa, Homo sapiens; identical to SEQ ID NO: 751393

SEQ ID NO: 751406 - protein, 134 aa, Homo sapiens
QARGLTKPESITARDTNERRSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751407 - protein, 132 aa, Homo sapiens
MPISLRSLNYCRGLLTYITYITCCGEGTVIGSVIMSPIMGDCWKYIDWHLLKQRNRSELEICDYCPRTGDTKHVLTGSADNSCRLWDCETGKQLALLKTNSAVRTCGFDFGGNIIMFSTDKQMGYQCLCELF

SEQ ID NO: 751408 - protein, 125 aa, Homo sapiens; identical to SEQ ID NO: 751393

SEQ ID NO: 751409 - protein, 152 aa, Homo sapiens
MKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLFWRGVGELLTEATPGQINDTPSLSRGHDHVL

SEQ ID NO: 751410 - protein, 114 aa, Homo sapiens
MKPILLQGHERSITQIKYNREGDLLFTVAKDPIVNVWYSVNGERLGTYMGHTGAVWCVDADWDTKHVLTGSADNSCRLWDCETVWRGVGELLTEATPGQINDTPSLSRGHDHVL

SEQ ID NO: 751411 - protein, 168 aa, Homo sapiens
MLVRPGVISSIHALRGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLFWRGVGELLTEATPGQINDTPSLSRGHDHVL

SEQ ID NO: 751412 - protein, 114 aa, Homo sapiens; identical to SEQ ID NO: 751410

SEQ ID NO: 751413 - protein, 100 aa, Homo sapiens
EMKKYTLENKEEGSLSDTEADAVSGQLPDPTTNPSAGKDGPSLLVVEQVRVVDLEGSLKVVYPSKADLALPLPSDCRALTPGPPVRVCLAGFAEVSMRQC

SEQ ID NO: 751414 - protein, 93 aa, Homo sapiens
WVVGAGLPRVTAGMKPILLQGHERSITQIKYNREGDLLFTVAKDPIVNVWYSVNGERLGTYMGHTGAVWCVDADCQRNSDAKGGTKTQGVMMT

SEQ ID NO: 751415 - protein, 136 aa, Homo sapiens
RLVEPRGDIGRGKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751416 - protein, 125 aa, Homo sapiens; identical to SEQ ID NO: 751393

SEQ ID NO: 751417 - protein, 125 aa, Homo sapiens; identical to SEQ ID NO: 751393

SEQ ID NO: 751418 - protein, 125 aa, Homo sapiens; identical to SEQ ID NO: 751393

SEQ ID NO: 751419 - protein, 140 aa, Homo sapiens
MRGSTHASLPRVTAGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751420 - protein, 141 aa, Homo sapiens
MRLGTRLGVRLLAYSGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751421 - protein, 125 aa, Homo sapiens; identical to SEQ ID NO: 751393

SEQ ID NO: 751422 - protein, 138 aa, Homo sapiens
WVVGAGLPRVTAGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751423 - protein, 125 aa, Homo sapiens; identical to SEQ ID NO: 751393

SEQ ID NO: 751424 - protein, 125 aa, Homo sapiens; identical to SEQ ID NO: 751393

SEQ ID NO: 751425 - protein, 104 aa, Homo sapiens
DSRGLPEETVLIVNVWYSVNGERLGTYMGHTGAVWCVDADWDTKHVLTGSADNSCRLWDCETGKQLALLKTNSAVRTCGFDFGGNIIMFSTDKQMGYQCLCELF

SEQ ID NO: 751426 - protein, 115 aa, Homo sapiens
MKPILLQGHERSITQIKYNREGDLLFTVAKDPIVNVWYSVNGERLGTYMGHTGAVWCVDADSDNSCRLWDCETGKQLALLKTNSAVRTCGFDFGGNIIMFSTDKQMGYQCLCELF

SEQ ID NO: 751427 - protein, 103 aa, Homo sapiens
RAARVTAGMKPILLQGHERSITQIKYNREGDLLFTVAKDPIVNVWYSVNGERLGTYMGHTGAVWCVDADWDTKHVLTGSADNSCRLWDCETDNNEPYMKIPCK

SEQ ID NO: 751428 - protein, 127 aa, Homo sapiens
WVVGAGLPRVTAGMKPILLQGHERSITQIKYNREGDLLFTVAKDPIVNVWYSVNGERLGTYMGHTGAVWCVDADWDTKHVLTGSADNSCRLWDCETVWRGVGELLTEATPGQINDTPSLSRGHDHVL

SEQ ID NO: 751429 - protein, 127 aa, Homo sapiens; identical to SEQ ID NO: 751428

SEQ ID NO: 751430 - protein, 103 aa, Homo sapiens; identical to SEQ ID NO: 751427

SEQ ID NO: 751431 - protein, 634 aa, Homo sapiens
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDDSQE

SEQ ID NO: 751432 - protein, 709 aa, Homo sapiens
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 751433 - protein, 749 aa, Homo sapiens
MGRLRLQEVANEAGDKNARPLARFSRSKSQNCLWNSLIDGLTGNVKEKPRPTIVHDPRPPEEILADELPQLDSSEVLVKTSFRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 751434 - protein, 76 aa, Homo sapiens
PSVKCFGRSWWLSVYPVHSWNCDPQGEENEAQRDSADDSMSPFAFYGVTDTLLMTAMVILFFYNSSSFPAPISYQN

SEQ ID NO: 751435 - protein, 409 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGNYSRLVSGLDSPAILVLVNYIFFKVFFKGTWTQPFDLASTREENFYVDETTVVKVPMMLQSSTISYLHDAELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 751436 - protein, 70 aa, Homo sapiens
MLQSSTISYLHDAELPCQLVQMNYVGNGTVFFILPDKGKMNTVIAALSRDTINRWSAGLTSSQVDLPSCC

SEQ ID NO: 751437 - protein, 106 aa, Homo sapiens
HSWSQGPLLPAGRSLQSSASSRGSPGTKKASLWTIVLDAPWSSCIPGGISSKELQRRKECAIQRPRGKAACVMEAETDPASCSVPSPTHKEQVRLEGRSWRERMRK

SEQ ID NO: 751438 - protein, 387 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGNYIFFKGTWTQPFDLASTREENFYVDETTVVKVPMMLQSSTISYLHDAELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 751439 - protein, 369 aa, Homo sapiens
MPLLLYTCLLWLPTSGLWTVQAMDPNAAYVNMSNHHRGLASANVDFAFSLYKHLVALSPTLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGNYIFFKGTWTQPFDLASTREENFYVDETTVVKVPMMLQSSTISYLHDAELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 751440 - protein, 237 aa, Homo sapiens
MSRIRHRGTIVDLFSGLDSPAILVLVNYIFFKVFFKGTWTQPFDLASTREENFYVDETTVVKVPMMLQSSTISYLHDAELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 751441 - protein, 351 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGNYSRLVSGLDSPAILVLVNYIFFKVFFKGTWTQPFDLASTREENFYVDETTVVKVPMMLQSSTISYLHDAELPCQLVQMNYVGNGTVFFILPDKGKMNTVIAALSRDTINRWSAGLTSSQVDLYIPKVTISGVYDLGDVLEEMGIADLWSIKLCCNSMRRVWTQLAPLGSP

SEQ ID NO: 751442 - protein, 61 aa, Homo sapiens
MLQSSTISYLHDAELPCQLVQMNYVGNGTVFFILPDKGKMNTVIAALSRDTINRWSAGLTS

SEQ ID NO: 751443 - protein, 237 aa, Homo sapiens; identical to SEQ ID NO: 751440

SEQ ID NO: 751444 - protein, 172 aa, Homo sapiens
MLQSSTISYLHDAELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 751445 - protein, 206 aa, Homo sapiens
MVQLHPRWNQLEGIAEKKRMCNSEAPWESCLCHGGRDRSCLLLCPFSYPQRASQAGGQELEGAHEEIRVWPGEEVLLSPLPGPALECLTLSAYPERQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 751446 - protein, 291 aa, Homo sapiens
PTRPVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 751447 - protein, 147 aa, Homo sapiens
AVLFWGREEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 751448 - protein, 196 aa, Homo sapiens
PTRPVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVRSTFC

SEQ ID NO: 751449 - protein, 362 aa, Homo sapiens
ADNANLDPVDKFSKLRPLISKLNERCMKFVPNETYFSFDEFMVPYFGRHGCKQFIRGKPIRFGYKFWCGATCLGYICWFQPYQGKNPNTKHEEYGVGASLVLQFSEALTEAHPGQYHFVFNNFFTSIALLDKLSSMGHQATGTVRKDHIDRVPLESDVALKKKERGTFDYRIDGKGNIVCRWNDNSVVTVASSGAGIHPLCLVSRYSQKLKKKIQVQQPNMIKVYNQFMGGVDRADENIDKYRASIRGKKWYSSPLLFCFELVLQNAWQLHKTYDEKPVDFLEFRRRVVCHYLETHGHPPEPGQKGRPQKRNIDSRYDGINHVIVKQGKQTRCAECHKNTTFRCEKCDVALHVKCSVEYHTE

SEQ ID NO: 751450 - protein, 362 aa, Homo sapiens; identical to SEQ ID NO: 751449

SEQ ID NO: 751451 - protein, 385 aa, Homo sapiens
AGASGSVLVGASMWVCSTLWRVRTPARQWRGLLPASGCHGPAASSYSASAEPARVRALVYGHHGDPAKVVELKNLELAAVRGSDVRVKMLAAPINPSDINMIQGNYGLLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVSLLIFKDLKLRGFWLSQWKKDHSPDQFKELILTLCDLIRRGQLTAPACSQVPLQDYQSALEASMKPFISSKQILTM

SEQ ID NO: 751452 - protein, 81 aa, Homo sapiens
SRGVRLCVGWSEHVGLQYPVAGANPRPAVAGAAPSFWLSRTCRLLLLRIRRACPGPGACLWAPRGSSQGRRTTVLLTASSY

SEQ ID NO: 751453 - protein, 297 aa, Homo sapiens
MLAAPINPSDINMIQGNYGLLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVSLLIFKDLKLRGFWLSQWKKDHSPDQFKELILTLCDLIRRGQLTAPACSQVPLQDYQSALEASMKPFISSKQILTM

SEQ ID NO: 751454 - protein, 297 aa, Homo sapiens; identical to SEQ ID NO: 751453

SEQ ID NO: 751455 - protein, 310 aa, Homo sapiens
AAAPTSDWYVRVKMLAAPINPSDINMIQGNYGLLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVSLLIFKDLKLRGFWLSQWKKDHSPDQFKELILTLCDLIRRGQLTAPACSQVPLQDYQSALEASMKPFISSKQILTM

SEQ ID NO: 751456 - protein, 290 aa, Homo sapiens
AGASGSVLVGASMWVCSTLWRVRTPARQWRGLLPASGCHGPAASSYSASAEPARVRALVYGHHGDPAKVVELKNLELAAVRGSDVRVKMLAAPINPSDINMIQGNYGLLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLAF

SEQ ID NO: 751457 - protein, 466 aa, Homo sapiens
AGASGSVLVGASMWVCSTLWRVRTPARQWRGLLPASGCHGPAASSYSASAEPARVRALVYGHHGDPAKVVELKNLELAAVRGSDVRVKMLAAPINPSDINMIQGNYGLLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKIRKLRLRKEEMLNQNHIVYKGSRESELASVSPNSKPLNLPEPPPHKCLDMPQPRLALNCVGGKSSTELLRQLARGGTMVTYGGMAKQPVVASVSLLIFKDLKLRGFWLSQWKKDHSPDQFRADPHKVDLIRRRQVKACCPVPAEQAGLELISLNSRISQESKLVEEGGWGERPGHAKGQPHERNRAGKERANKNAAHGETTS

SEQ ID NO: 751458 - protein, 215 aa, Homo sapiens
AGASGSVLVGASMWVCSTLWRVRTPARQWRGLLPASGCHGPAASSYSASAEPARVRALVYGHHGDPAKVVELKNLELAAVRGSDVRVKMLAAPINPSDINMIQGNYGLLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQP

SEQ ID NO: 751459 - protein, 385 aa, Homo sapiens; identical to SEQ ID NO: 751451

SEQ ID NO: 751460 - protein, 270 aa, Homo sapiens
AGASGSVLVGASMWVCSTLWRVRTPARQWRGLLPASGCHGPAASSYSASAEPARVRALVYGHHGDPAKVVELKNLELAAVRGSDVRVKMLAAPINPSDINMIQGNYGLLPELPAVGGNEGVAQVVAVGSIKNVRGPGEARRLVTSQGQKIWAFWGIFYRGGNNPLCVGAGGENPPVNGALGSGFSTNSGSAGDTNGRREKRAHTLWVISPPEKGFFPPRESGVVEANFFRHRFSFFSHQHTATILAGRRNSHTKSSHPVRSKYTPSQSTQ

SEQ ID NO: 751461 - protein, 297 aa, Homo sapiens; identical to SEQ ID NO: 751453

SEQ ID NO: 751462 - protein, 297 aa, Homo sapiens; identical to SEQ ID NO: 751453

SEQ ID NO: 751463 - protein, 289 aa, Homo sapiens
AGASGSVLVGASMWVCSTLWRVRTPARQWRGLLPASGCHGPAASSYSASAEPARVRALVYGHHGDPAKVVELKNLELAAVRGSDVRVKMLAAPINPSDINMIQGNYGLLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLA

SEQ ID NO: 751464 - protein, 234 aa, Homo sapiens
MLAAPINPSDINMIQGNYGLLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVVSWVQREACLEPG

SEQ ID NO: 751465 - protein, 366 aa, Homo sapiens
MAGPRVEVDGSIMEGGGQILRVSTALSCLLGLPLRVQKIRAGRSTPGLRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGNGNGIIIIAETSTGCLFAGSSLGKRGVNADKVGIEAAEMLLANLRHGGTVDEYLQDQLIVFMALANGVSRIKTGPVTLHTQTAIHFAEQIAKAKFIVKKSEDEEDAAKDTYIIECQGIGMTNPNL

SEQ ID NO: 751466 - protein, 366 aa, Homo sapiens
MAGPRVEVDGSIMEGGGQILRVSTALSCLLGLPLRVQKIRAGRSTPGLRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGNGNGIIIMAETSMGWWEAGSSLGKRGVNADKVGIEAAEMLLANLRHGGTVDEYLQDQLIVFMALANGVSRIKTGPVTLHTQTAIHFAEQIAKAKFIVKKSEDEEDAAKDTYIIECQGIGMTNPNL

SEQ ID NO: 751467 - protein, 309 aa, Homo sapiens
MIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGNGNGIIIIAETSTGCLFAGSSLGKRGVNADKVGIEAAEMLLANLRHGGTVDEYLQDQLIVFMALANGVSRIKTGPVTLHTQTAIHFAEQIAKAKFIVKKSEDEEDAAKDTYIIECQGIGMTNPNL

SEQ ID NO: 751468 - protein, 379 aa, Homo sapiens
MAGPRVEVDGSIMEGGGQILRVSTALSCLLGLPLRVQKIRAGRSTPGLSSGGWKSKIKVLTRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGNGNGIIIIAETSTGCLFAGSSLGKRGVNADKVGIEAAEMLLANLRHGGTVDEYLQDQLIVFMALANGVSRIKTGPVTLHTQTAIHFAEQIAKAKFIVKKSEDEEDAAKDTYIIECQGIGMTNPNL

SEQ ID NO: 751469 - protein, 366 aa, Homo sapiens; identical to SEQ ID NO: 751465

SEQ ID NO: 751470 - protein, 158 aa, Homo sapiens
MAGPRVEVDGSIMEGGGQILRVSTALSCLLGLPLRVQKIRAGRSTPGLRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTR

SEQ ID NO: 751471 - protein, 570 aa, Homo sapiens
MLLLLSDQLLLTALRKPNPQAMAALFLSAPPQAEVTFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTVPTCVSISGFTSGRTSPCNSGAVSEGRVQLSTSCMRPRHLTLPFMYYPHDVFTE

SEQ ID NO: 751472 - protein, 530 aa, Homo sapiens
MLLLLSDQLLLTALRKPNPQAMAALFLSAPPQAEVTFEDVAVYLSREEWGRLGPAQRGLYRDVMLETYGNLVSLALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTVPTCVSISGFTSGRTSPCNSGAVSEGRVQLSTSCMRPRHLTLPFMYYPHDVFTE

SEQ ID NO: 751473 - protein, 560 aa, Homo sapiens
MLLLLSDQLLLTALRKPNPQAMAALFLSAPPQAEVTFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRRIHTGEKPYKCSECGKAFRHSSNMCQHQRIHLREDFSM

SEQ ID NO: 751474 - protein, 560 aa, Homo sapiens; identical to SEQ ID NO: 751473

SEQ ID NO: 751475 - protein, 570 aa, Homo sapiens; identical to SEQ ID NO: 751471

SEQ ID NO: 751476 - protein, 204 aa, Homo sapiens
MAAAEAVHHIHLQNFSRSLLETLNGQRLGGHFCDVTVRIREASLRAHRCVLAAGSPFFQDKLLLGHSEIRVPPVVPAQTVRQLVEFLYSGSLVVAQGEALQVLTAASVLRIQTVIDECTQIIARARAPGTSAPQCPWPIACCTRRPTSGSLVDDLVVQCGHGGHTCLVLSVPRGHPGVTLLERGALYACAEALGVLLDGTGALL

SEQ ID NO: 751477 - protein, 394 aa, Homo sapiens
MAAAEAVHHIHLQNFSRSLLETLNGQRLGGHFCDVTVRIREASLRAHRCVLAAGSPFFQDKLLLGHSEIRVPPVVPAQTVRQLVEFLYSGSLVVAQGEALQVLTAASVLRIQTVIDECTQIIARARAPGTSAPTPLPTPVPPPLAPAQLRHRLRHLLAARPPGHPGAAHSRKQRQPARLQLPAPPTPAKAEGPDADPSLSAAPDDRGDEDDEESDDETDGEDGEGGGPGEGQAPPSFPDCAAGFLTAAADSACEEPPAPTGLADYSGAGRDFLRGAGSAEDVFPDSYVSTWHDEDGAVPEGCPTETPVQPDCILSGSRPPGVKTPGPPVALFPFHLGAPGPPAPPPSAPSGPAPAPPPAFYPTLQPEAAPSTQLGEVPAPSVVRPLLRTGLFPA

SEQ ID NO: 751478 - protein, 394 aa, Homo sapiens; identical to SEQ ID NO: 751477

SEQ ID NO: 751479 - protein, 511 aa, Homo sapiens
MAAAEAVHHIHLQNFSRSLLETLNGQRLGGHFCDVTVRIREASLRAHRCVLAAGSPFFQDKLLLGHSEIRVPPVVPAQTVRQLVEFLYSGSLVVAQGEALQVLTAASVLRIQTVIDECTQIIARARAPGTSAPTPLPTPVPPPLAPAQLRHRLRHLLAARPPGHPGAAHSRKQRQPARLQLPAPPTPAKAEGPDADPSLSAAPDDRGDEDDEESDDETDGEDGEGGGPGEGQAPPSFPDCAAGFLTAAADSACEEPPAPTGLADYSGAGRDFLRGAGSAEDVFPDSYVSTWHDEDGAVPEGCPTETPVQPDCILSGSRPPGVKTPGPPVALFPFHLGAPGPPAPPPSAPSGPAPAPPPAFYPTLQPEAAPSTQLGEVPAPSAAPTTAPSGTPARTPGAEPPTYECSHCRKTFSSRKNYTKHMFIHSGEKPHQCAVCWRSFSLRDYLLKHMVTHTGVRAFQCAVCAKRFTQKSSLNVHMRTHRPERAPCPACGKVFSHRALLERHLAAHPAP

SEQ ID NO: 751480 - protein, 133 aa, Homo sapiens
MAAAEAVHHIHLQNFSRSLLETLNGQRLGGHFCDVTVRIREASLRAHRCVLAAGSPFFQDKLLLGHSEIRVPPVVPAQTVRQLVEFLYSGSLVVAQGEALQVLTAASVLRIQTVIDECTQIIARARAPGTSAL

SEQ ID NO: 751481 - protein, 511 aa, Homo sapiens; identical to SEQ ID NO: 751479

SEQ ID NO: 751482 - protein, 511 aa, Homo sapiens; identical to SEQ ID NO: 751479

SEQ ID NO: 751483 - protein, 485 aa, Homo sapiens
MAAAEAVHHIHLQNFSRSLLETLNGQRLGGHFCDVTVRIREASLRAHRCVLAAGSPFFQDKLLLGHSEIRVPPVVPAQTVRQLVEFLYSGSLVVAQGEALQVLTAASVLRIQTVIDECTQIIARARAPGTSAPTPLPTPVPPPLAPAQLRHRLRHLLAARPPGHPGAAHSRKQRQPARLQLPAPPTPAKAEGPDADPSLSAAPDDRGDEDDEESDDETDGEDGEGGGPGEGQAPPSFPDCAAGFLTAAADSACEEPPAPTGLADYSGAGRDFLRGAGSAEDVFPDSYVSTWHDEDGAVPEGCPTETPVQPDCILSGSRPPGVKTPGPPVALFPFHLGAPGPPAPPPSAPSGPAPAPPPAFYPTLQPEAAPSTQLGEVPAPSAAPTTAPSGTPARTPGAEPPTYECSHCRKTFSSRKNYTKHMFIHSGEKPHQCAVCWRSFSLRDYLLKHMVTHTGVRAFQCAVCAKRFTQKCAWVRTQAHFWGVV

SEQ ID NO: 751484 - protein, 61 aa, Homo sapiens
GVGWGRGAVESDLRSRPALSSAGEKPHQCAVCWRSFSLRDYLLKHMVTHTGVRAFQCAVCA

SEQ ID NO: 751485 - protein, 1493 aa, Homo sapiens
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRFEGLGPTVIVCPTTVMHQWVKEFHTWWPPFRVAILHETGSYTHKKEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 751486 - protein, 1430 aa, Homo sapiens
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRRNYIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDENWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 751487 - protein, 1293 aa, Homo sapiens
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRRNYIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDENWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQVI

SEQ ID NO: 751488 - protein, 694 aa, Homo sapiens
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLSPKMPRTLSLHEITDLLETDDSIEASAIVIQPPENATAPVSDEESGDEEGGTINNLPGSLLHTAAYLIQDGSDAESDSDDPSYAPKDDSPDEVPSTFTVQQPPPSRRRKMTKILCKWKKADLTVQPVAGRVTAPPNDFFTVMRTPTEILELFLDDEVIELIVKYSNLYACSKGVHLGLTSSEFKCFLGIIFLSGYVSVPRRRMFWEQRTDVHNVLVSAAMRRDRFETIF

SEQ ID NO: 751489 - protein, 277 aa, Homo sapiens
CLTHSESLPAAPRVTDTQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 751490 - protein, 43 aa, Homo sapiens
MPGCAGRHALGGPGRGRNIPPRVPAGPGGRRRLLAPPWRPPPL

SEQ ID NO: 751491 - protein, 138 aa, Homo sapiens
SRNPGGPGVTDVEEGLRPSGALGYEYSGDVRSARVNALLPALCRCSHLSSLSLSDNPISSACLLSLLEHTMGLMELKQVLYPIPVDCCIYLHGVCRGPMNEDKLCQLQAEIQKQLQAMQQADMQWSPSTVFAYAAGAV

SEQ ID NO: 751492 - protein, 111 aa, Homo sapiens
LQPSALFDIDWAGATVTPRPGCGGPLSHTPRQGVRRGQMSITETKPWLWRPFLPSQGLGSMCSELHFRKAAAARDTLSTAGDLWGCAAFMVSVGFLFSPSFVLAAVSEADG

SEQ ID NO: 751493 - protein, 582 aa, Homo sapiens
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTEQFTFEYSRRHPDLSIPELLRIVQIYKDLLRNCCNTENPPGCYRYAEDKFNETTEKSLKMVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 751494 - protein, 353 aa, Homo sapiens
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTDSLLLNTQGDIQTCLYQSF

SEQ ID NO: 751495 - protein, 599 aa, Homo sapiens
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTDSENVCQERDADPDTFFAKFTFEYSRRHPDLSIPELLRIVQIYKDLLRNCCNTENPPGCYRYAEDKFNETTEKSLKMVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 751496 - protein, 189 aa, Homo sapiens
MVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 751497 - protein, 599 aa, Homo sapiens; identical to SEQ ID NO: 751495

SEQ ID NO: 751498 - protein, 481 aa, Homo sapiens
MEGLPRFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTDSENVCQERDADPDTFFAKFTFEYSRRHPDLSIPELLRIVQIYKDLLRNCCNTENPPGCYRYAEDKFNETTEKSLKMVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 751499 - protein, 353 aa, Homo sapiens; identical to SEQ ID NO: 751494

SEQ ID NO: 751500 - protein, 195 aa, Homo sapiens
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVASTRPRI

SEQ ID NO: 751501 - protein, 104 aa, Homo sapiens
WSKLLNDLFPFSYRKLDNEDLHPGQEQRKDLSKSYYIFNYLKYAFLYKGGRVIATGLLHELDDCNRRISVARCDAVIGSPGTTLELRLAERYPVRTRDILRPAV

SEQ ID NO: 751502 - protein, 555 aa, Homo sapiens
LFWQTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRADIIDPAILRPGRLDQLIYIPLPDEKSRVAILKANLRKSPVARNVDLEFLVKWTNGFSGADLTEICQRACKLAIRESSRVRLGRTREADKPISHGVEEDDPVPEIRRDPLEEAMRWAAVLSVTLTFRSMTCLARPFSRVGALAASDSLQGTRVELAPVRAVEAAQVAVYTQKTMMMTCMAKWWWPACSELACLDLVPWGWGLPRRGTRGAPTACSILQSEQFSYSLTLDRGFLLKKYKTKA

SEQ ID NO: 751503 - protein, 396 aa, Homo sapiens
NVSTRLVLIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRADIIDPAILRPGRLDQLIYIPLPDEKSRVAILKANLRKSPVARNVDLEFLVKWTNGFSGADLTEICQRACKLAIRESSRVRLGRTREADKPISHGVEEDDPVPEIRRDPLEEAMRWAAVLSVTLTFRSMTCLARPFSRVGALAASDSLQGTRVELAPVRAVEAAQVAVYTQKTMMMTCMAKWWWPACSELACLDLVPWGWGLPRRGTRGAPTACSILQSEQFSYSLTLDRGFLLKKYKTKA

SEQ ID NO: 751504 - protein, 220 aa, Homo sapiens
MHAHTCACWGREWRMRGRRKVGGTDFLCIVPLFQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751505 - protein, 340 aa, Homo sapiens
RKGAGPRLAGAGKMAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751506 - protein, 155 aa, Homo sapiens
MTKHTDATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751507 - protein, 157 aa, Homo sapiens
PTRPRTRGATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751508 - protein, 137 aa, Homo sapiens
RKGAGPRLAGAGKMAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQCESGIDVGKRSGS

SEQ ID NO: 751509 - protein, 118 aa, Homo sapiens
RKGAGPRLAGAGKMAAAAAAAAATNGTGGSSGMEVDAAVVPSVMACGVTGSVSVALHPLVILNISDHWIRMRSQEGRPVQVQDDLVALELAKHVRARKIIDGECNIRLHVCVVPPPGA

SEQ ID NO: 751510 - protein, 340 aa, Homo sapiens; identical to SEQ ID NO: 751505

SEQ ID NO: 751511 - protein, 340 aa, Homo sapiens; identical to SEQ ID NO: 751505

SEQ ID NO: 751512 - protein, 340 aa, Homo sapiens; identical to SEQ ID NO: 751505

SEQ ID NO: 751513 - protein, 340 aa, Homo sapiens; identical to SEQ ID NO: 751505

SEQ ID NO: 751514 - protein, 340 aa, Homo sapiens; identical to SEQ ID NO: 751505

SEQ ID NO: 751515 - protein, 340 aa, Homo sapiens; identical to SEQ ID NO: 751505

SEQ ID NO: 751516 - protein, 340 aa, Homo sapiens; identical to SEQ ID NO: 751505

SEQ ID NO: 751517 - protein, 340 aa, Homo sapiens; identical to SEQ ID NO: 751505

SEQ ID NO: 751518 - protein, 396 aa, Homo sapiens
RKGAGPRLAGAGKMAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRQLSQRGGHYTSLRETAVINKRGAAPEHPCWWLCPLLGTTLVGQLGCSSRLILALLRSPSDALQ

SEQ ID NO: 751519 - protein, 310 aa, Homo sapiens
SLAGVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751520 - protein, 231 aa, Homo sapiens
MIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751521 - protein, 231 aa, Homo sapiens
MLTSFKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751522 - protein, 179 aa, Homo sapiens
MLAYSVQVSPSPSQLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751523 - protein, 147 aa, Homo sapiens
MLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751524 - protein, 171 aa, Homo sapiens
MTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751525 - protein, 179 aa, Homo sapiens
NQPVTQKQLYQAHRLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751526 - protein, 137 aa, Homo sapiens
DHTRGLMAISQTASAQKQRLACHRLVLLRVLSGQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751527 - protein, 221 aa, Homo sapiens
RKGAGPRLAGAGKMAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLERSPLIMRSCGRPMLCVTVSRCSAQTSSRQIFMINATTWGSWPTSAPSPKRATP

SEQ ID NO: 751528 - protein, 340 aa, Homo sapiens; identical to SEQ ID NO: 751505

SEQ ID NO: 751529 - protein, 203 aa, Homo sapiens
EGGGAEAGGRGENGGGGGGGCSYERDRRKQRDGGGCSSSPQRDGLRSDWECFRRSPSPCHSQHLRPLDPHALPGGAACAGVSVGHRLQSLLLAHLPQAVVFSPSSTGANSPSPKSSFPQYMVPTDLRPSGHRSFFTLTFSMSFSFPVIGALIGKQEGRNIEVMNSFELLSHTVEEKIIIDKEYYYTKEEQCESGIDVGKRSGS

SEQ ID NO: 751530 - protein, 340 aa, Homo sapiens; identical to SEQ ID NO: 751505

SEQ ID NO: 751531 - protein, 340 aa, Homo sapiens; identical to SEQ ID NO: 751505

SEQ ID NO: 751532 - protein, 340 aa, Homo sapiens; identical to SEQ ID NO: 751505

SEQ ID NO: 751533 - protein, 340 aa, Homo sapiens; identical to SEQ ID NO: 751505

SEQ ID NO: 751534 - protein, 323 aa, Homo sapiens
MGQYEAGCIIRHRGGMEVVAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751535 - protein, 269 aa, Homo sapiens
PPDGVGSVEVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751536 - protein, 230 aa, Homo sapiens
ANSLVIRDCEKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751537 - protein, 370 aa, Homo sapiens
RKGAGPRLAGAGKMAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEVIPYTFNPQILLLASFLLLILPLWVTLPCEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751538 - protein, 324 aa, Homo sapiens
RKGAGPRLAGAGKMAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 751539 - protein, 275 aa, Homo sapiens
RKGAGPRLAGAGKMAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGTCPATWPDTYLNTQ

SEQ ID NO: 751540 - protein, 289 aa, Homo sapiens
FKLLLLGVIIFLVNEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRQLSQRGGHYTSLRETAVINKRGAAPEHPCWWLCPLLGTTLVGQLGCSSRLILALLRSPSDALQ

SEQ ID NO: 751541 - protein, 124 aa, Homo sapiens
EVAVRWWLWLRPSQRLFTHIPVAWSGKTQAVWGWDSCSSPSSVYVYIFHVISPMWCLLGYCTKYRLTQGSHSACPKREPSRSHFAFLTAPWKSHSICHIPLVEAGGKVTLGTREHRPHVSIEEC

SEQ ID NO: 751542 - protein, 75 aa, Homo sapiens
VVPLSLDPDQKIEIETDEENECRNPRWTLTAGNMEETYFHLFLSISIKDHKRPSRDFQNPNNDTMMRKGRLREGK

SEQ ID NO: 751543 - protein, 691 aa, Homo sapiens
PCQLAQALSPRRAFPRELKEKGQRMSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 751544 - protein, 658 aa, Homo sapiens
MSSQPAGNQTSPGATEDYSYGSWYIDEPQGGEELQPEGEVPSCHTSIPPGLYHACLASLSILVLLLLAMLVRRRQLWPDCVRGRPGLPRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 751545 - protein, 159 aa, Homo sapiens
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGNLPKITELRLVRAWI

SEQ ID NO: 751546 - protein, 72 aa, Homo sapiens
RYSSAPRYSSAPGHTAAHLLGSTLSWAHLGVQVWQRAECPQVPKMNSEVPMNSEVPDEYEVPMNSEVPMYTK

SEQ ID NO: 751547 - protein, 667 aa, Homo sapiens
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 751548 - protein, 286 aa, Homo sapiens
MRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 751549 - protein, 249 aa, Homo sapiens
LRLGAGRVLIGRGLLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 751550 - protein, 512 aa, Homo sapiens
PCQLAQALSPRRAFPRELKEKGQRMSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGEPPLPATPSLGLGLPSDTGLSWGEECSASTALRVCLGMLWGSSKKEGPPCLPCP

SEQ ID NO: 751551 - protein, 145 aa, Homo sapiens
GLAGCLLSDSQKVRLSQGCSCYRQRTPWPRELGPGPAAAGLAGVWPTRCCTTQPCRSSARRPCWVPMVPSPEGREGQPTCPSVLRHVPAYHPPPSPALLPASHQPCSQQVLRITVVGWRSVCTGSLRRALLHPLGYGRASRGSGE

SEQ ID NO: 751552 - protein, 272 aa, Homo sapiens
RLGRAWCEVGRGVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPVIKPEILK

SEQ ID NO: 751553 - protein, 667 aa, Homo sapiens; identical to SEQ ID NO: 751547

SEQ ID NO: 751554 - protein, 667 aa, Homo sapiens; identical to SEQ ID NO: 751547

SEQ ID NO: 751555 - protein, 728 aa, Homo sapiens
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGNLPKITELRLVRAWIEPSVLAQLNVLKGLEAGDRREAWVGSLQAPCLPLQHGSLCLFHLPGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 751556 - protein, 103 aa, Homo sapiens
RYQTPPLHNIQAKNYKNIWLSSQHHTSHAASRSSGSLWLGGGLSALGASGGLCSTHLAMGEPAGVLEKKTGGLGPWSRSQLSQGSHIQASPYPGSAISLEGPR

SEQ ID NO: 751557 - protein, 334 aa, Homo sapiens
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGAEQYSEEYPREPPLTGTGGEEVTQLQEWLLAGALRWLRTCVYIPTTESTSREAGVHLTRQERRYNRGHSRGGASPTQEGGEPRRCSLAQRRSE

SEQ ID NO: 751558 - protein, 187 aa, Homo sapiens
GRGSREHGRAPGLPPSPSCSARVLGRPEPLRGASLSLDPAAKAESVRLSPGPRLERSLAASKGAGVWKPGLGQIPFAVVSVIAGTEFPSSGEKGRRSRPSRCPEWGGETLRVGARGPGARAEAAGAQGVPLSPSPPSPLPGLSTVSVGARQGAHVPREENGAGGWARTAAVLAELLARGLCASVYPS

SEQ ID NO: 751559 - protein, 430 aa, Homo sapiens
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYSRYPPGVVGVAPTGIPAAVEGIVPSAMSLSHGLPPVAHPPHAPSPGQTVKPEADRDHASDQL

SEQ ID NO: 751560 - protein, 430 aa, Homo sapiens; identical to SEQ ID NO: 751559

SEQ ID NO: 751561 - protein, 430 aa, Homo sapiens; identical to SEQ ID NO: 751559

SEQ ID NO: 751562 - protein, 430 aa, Homo sapiens; identical to SEQ ID NO: 751559

SEQ ID NO: 751563 - protein, 416 aa, Homo sapiens
MSGVRPPIMNGPCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYSRYPPGVVGVAPTGIPAAVEGIVPSAMSLSHGLPPVAHPPHAPSPGQTVKPEADRDHASDQL

SEQ ID NO: 751564 - protein, 430 aa, Homo sapiens; identical to SEQ ID NO: 751559

SEQ ID NO: 751565 - protein, 414 aa, Homo sapiens
PPHAPGSRRRSAPEWSGPAAARASRWAARTCSTRACRLVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYSRYPPGVVGVAPTGIPAAVEGIVPSAMSLSHGLPPVAHPPHAPSPGQTVKPEADRDHASDQL

SEQ ID NO: 751566 - protein, 430 aa, Homo sapiens; identical to SEQ ID NO: 751559

SEQ ID NO: 751567 - protein, 430 aa, Homo sapiens; identical to SEQ ID NO: 751559

SEQ ID NO: 751568 - protein, 430 aa, Homo sapiens; identical to SEQ ID NO: 751559

SEQ ID NO: 751569 - protein, 297 aa, Homo sapiens
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSSWPNRQARGG

SEQ ID NO: 751570 - protein, 430 aa, Homo sapiens; identical to SEQ ID NO: 751559

SEQ ID NO: 751571 - protein, 205 aa, Homo sapiens
QQNQQSASVQTGHFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYSRYPPGVVGVAPTGIPAAVEGIVPSAMSLSHGLPPVAHPPHAPSPGQTVKPEADRDHASDQL

SEQ ID NO: 751572 - protein, 192 aa, Homo sapiens
QPACRAEQGRGVCGSQAGPPTGGSSAQPPPLRTQPQHSGCTDHACAVPSFSQGPLKDAPNLICTPHAAWYSEQASIEMREEAAREIRRAITGRIPDSLKNCVNKDHLTAATHWASMDPAVVHPELNGAAYSRYPPGVVGVAPTGIPAAVEGIVPSAMSLSHGLPPVAHPPHAPSPGQTVKPEADRDHASDQL

SEQ ID NO: 751573 - protein, 115 aa, Homo sapiens
MREEAAREIRRAITGRIPDSLKNCVNKDHLTAATHWASMDPAVVHPELNGAAYSRYPPGVVGVAPTGIPAAVEGIVPSAMSLSHGLPPVAHPPHAPSPGQTVKPEADRDHASDQL

SEQ ID NO: 751574 - protein, 109 aa, Homo sapiens
CSFLLHLPGRIPDSLKNCVNKDHLTAATHWASMDPAVVHPELNGAAYSRYPPGVVGVAPTGIPAAVEGIVPSAMSLSHGLPPVAHPPHAPSPGQTVKPEADRDHASDQL

SEQ ID NO: 751575 - protein, 199 aa, Homo sapiens
GRPTRRARGGAARRSGRGPRPLAPLDGQLALAQQGPAACKTLTPTQASVIAADQKPEHFGSMGLPIAGTLRAWWAWPPLASQLLWKVSSPAPCPCPTACPLWPTRPTPLLLAKPSSPRRIETTPVTSCSPGGALQPRRLGRGPGNPRTRVCGGGICVVALALQRLVRAVRRREGAALGLVSLVVVRPVGALPCVLRVPR

SEQ ID NO: 751576 - protein, 106 aa, Homo sapiens
MPIKVGLTQGVFPSPERCKNDGPIEVNTTHYSGPNWGTGVPRPRRLGRGPGNPRTRVCGGGICVVALALQRLVRAVRRREGAALGLVSLVVVRPVGALPCVLRVPR

SEQ ID NO: 751577 - protein, 321 aa, Homo sapiens
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQAGGRSSGRRRGRPTRRARGGAARRSGRGPRP

SEQ ID NO: 751578 - protein, 273 aa, Homo sapiens
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGASAAAPRLCPSLCLALPLFSCAQEERPGAGWGCCRCRSQPRTGLSAHRHQGPGVPGVCPTCTDVTAHVGLTQAHTDNVHGCHSTHSLTQTSQHVGLMGTCR

SEQ ID NO: 751579 - protein, 101 aa, Homo sapiens
TGGRAFPQFPCPQHTPCALRPLVLGHWGHLDAARACGGGRSPGGLFPGVGLGATGARPRAWHCNLRVSALRVCGRSRGPWLSAGPRVQVGPRQQSRVWQMQ

SEQ ID NO: 751580 - protein, 76 aa, Homo sapiens
PGRLQVGLTDGPSPSRYPPGVVGVAPTGIPAAVEGIVPSAMSLSHGLPPVAHPPHAPSPGQTVKPEADRDHASDQL

SEQ ID NO: 751581 - protein, 466 aa, Homo sapiens
AAPRAGLAAAQRAGVVGARGRSRLSMGSSHLLNKGLPLGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYSRYPPGVVGVAPTGIPAAVEGIVPSAMSLSHGLPPVAHPPHAPSPGQTVKPEADRDHASDQL

SEQ ID NO: 751582 - protein, 466 aa, Homo sapiens; identical to SEQ ID NO: 751581

SEQ ID NO: 751583 - protein, 430 aa, Homo sapiens; identical to SEQ ID NO: 751559

SEQ ID NO: 751584 - protein, 179 aa, Homo sapiens
SGLCLRCQQPGARSQEQSASMNLGVSMLRILFLLDVGGAQVLATGKTPGAEIDFKYALIGTAVGVAISAGFLALKICMIRRHLFDDDSSDLKSTPGGLSDTIPLKKRAPRAHVLRDGPALGPLHLLFSVIGMLFARKLQASTLFSFKSLLQCHHCIMEGLFKAKPQFLQKVSCKSDHLS

SEQ ID NO: 751585 - protein, 122 aa, Homo sapiens
RLYRSQRRKMEPRAERHMNLGVSMLRILFLLDVGGAQVLATGKTPGAEIDFKYALIGTAVGVAISAGFLALKICMIRRHLFDDDSSDLKSTPGGLSDTIPLKKRAPRRNHNFSKRDAQVIEL

SEQ ID NO: 751586 - protein, 131 aa, Homo sapiens
RLYRSQRRKMEPRAERHMNLGVSMLRILFLLDVGGAQVLATGKTPGAEIDFKYALIGTAVGVAISAGFLALKICMIRRHLFDDDSSDLKSTPGGLSDTIPLKKRAPKAASLDPLFLQIPASVSPLHHGGPI

SEQ ID NO: 751587 - protein, 143 aa, Homo sapiens
MGQVACHPKKRGQPLLRPRARAAWTTGVVQEGRMRDVGGAQVLATGKTPGAEIDFKYALIGTAVGVAISAGFLALKICMIRRHLFDDDSSDLKSTPGGLSGEGCGARAWLCPTQRGTEGHSVMLATARMNPQAQSPTGCKGRQ

SEQ ID NO: 751588 - protein, 149 aa, Homo sapiens
GLSGQPWPLKFELMLCPWLQLPVVSRMNSRREDDRRGSRLRLCSLLCFLSEPGILHQAHRCCVAFWAPCQGLTLDSVFSPRLHPASAFGVGRPSRAPLVTGVRVCLGSPEAGLGRGREAAPTSSPIVSQPGSAQRAAPVMEKPLCLCRV

SEQ ID NO: 751589 - protein, 175 aa, Homo sapiens
MSPAMSDSGAPGGGQPDVFSSKSGLSSQQAATSDGQQVLLCAQIKNPPLRNSKPLRVLGQQGGERWRRNMGFLCSDCRDLGKDQPYTMSISCPLTWQGSKAQPRSYKKLRLARRGGHTCILSTGGQWQIVEPELRHLRTGEPSLKIRIPWGAVGSQQGREARPEKATIPVPGRSP

SEQ ID NO: 751590 - protein, 106 aa, Homo sapiens
STVPSKNLREGGPMGRKLRIRCWDHSCPDLPCDSVILSKGQTLLDQLEPPSRCPQPCQTLGPQAEGNQMSSAPSLASPPSKQPPLMANRCCCVPRSRIHLCGIQNR

SEQ ID NO: 751591 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 751592 - protein, 114 aa, Homo sapiens
MKRNTILSTEKSSAQLVHPIYSSSFQGRVTLSPTPSFQLCGWGNSPHPNPPHPLEHPRAWRRWGPFRKTPCQECITPPGRRPRKTEGLRREIRQALRPGHWRGRRSRKAESGTR

SEQ ID NO: 751593 - protein, 183 aa, Homo sapiens
MEKRELKASVPKFDKIPWLSEASLVNKPLVLSLPRRYPHTSATFLTSSKKNMNLPILFQVPDVLSKARRNQCDSMLLRNQQLCSTCQEMKMVQPRTMKIPDDPKASFENCMSYRMSLHQPKFQTTPEPFHDDIPTESIHYRLPILGPRTAVFHGLLTEAYKTLKERQRSSLPRKEPIGKTTRQ

SEQ ID NO: 751594 - protein, 154 aa, Homo sapiens
MEKRELKASVPKFDKIPWLSEASLVNKPLVLSLPRRYPHTSATFLTSSKKNMNLPILFQVPDVLSKARRNQCDSMLLRNQQLCSTCQEMKMVQPRTMKIPDDPKASFENCMSYRMSLHQPKFQTTPEPFHDDIPTGSVHNIWLKTFHGDGVQTK

SEQ ID NO: 751595 - protein, 1490 aa, Homo sapiens
MAGNSLVLPIVLWGRKAPTHCISAVLLTDDGATIVTGCHDGQICLWDLSVELQINPRALLFGHTASITCLSKACASSDKQYIVSASESGEMCLWDVSDGRCIEFTKLACTHTGIQFYQFSVGNQREGRLLCHGHYPEILVVDATSLEVLYSLVSKISPDWISSMSIIRSHRTQEDTVVALSVTGILKVWIVTSEISDMQDTEPIFEEESKPIYCQNCQSISFCAFTQRSLLVVCSKYWRVFDAGDYSLLCSGPSENGQTWTGGDFVSSDKVIIWTENGQSYIYKLPASCLPASDSFRSDVGKAVENLIPPVQHILLDRKDKELLICPPVTRFFYGCREYFHKLLIQGDSSGRLNIWNISDTADKQGSEEGLAMTTSISLQEAFDKLNPCPAGIIDQLSVIPNSNEPLKVTASVYIPAHGRLVCGREDGSIVIVPATQTAIVQLLQGEHMLRRGWPPHRTLRGHRNKVTCLLYPHQVSARYDQRYLISGGVDFSVIIWDIFSGEMKHIFCVHGGEITQLLVPPENCSARVQHCICSVASDHSVGLLSLREKKCIMLASRHLFPIQVIKWRPSDDYLVVGCSDGSVYVWQMDTGALDRCVMGITAVEILNACDEAVPAAVDSLSHPAVNLKQAMTRRSLAALKNMAHHKLQTLATNLLASEASDKGNLPKYSHNSLMVQAIKTNLTDPDIHVLFFDVEALIIQLLTEEASRPNTALISPENLQKASGSSDKGGSFLTGKRAAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQVAAPVVSARSDADHSGSDPPSAPALHTCFLVNEGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTGCLSSVPQMKKISTSYEERRKQATAIVLLGVIGAEFGAEIEPPKLLTRPRSSSQIPEGFGLTSGGSNYSLARHTCKALTFLLLQPPSPKLPPHSTIRRTAIDLIGRGFTVWEPYMDVSAVLMGLLELCADAEKQLANITMGLPLSPAADSARSARHALSLIATARPPAFITTIAKEVHRHTALAANTQSQQNMHTTTLARAKGEILRVIEILIEKMPTDVVDLLVEVMDIIMYCLEGSLVKKKGLQECFPAICRFYMVSYYERNHRIAVGARHGSVALYDIRTGKCQTIHGHKGPITAVAFAPDGRYLATYSNTDSHISFWQMNTSLLGSIGMLNSAPQLRCIKTYQVPPVQPASPGSHNALKLARLIWTSNRNVILMAHDGKEHRFMV

SEQ ID NO: 751596 - protein, 859 aa, Homo sapiens [sequence omitted]

SEQ ID NO: 751597 - protein, 1085 aa, Homo sapiens
MAGNSLVLPIVLWGRKAPTHCISAVLLTDDGATIVTGCHDGQICLWDLSVELQINPRALLFGHTASITCLSKACASSDKQYIVSASESGEMCLWDVSDGRCIEFTKLACTHTGIQFYQFSVGNQREGRLLCHGHYPEILVVDATSLEVLYSLVSKISPDWISSMSIIRSHRTQEDTVVALSVTGILKVWIVTSEISDMQDTEPIFEEESKPIYCQNCQSISFCAFTQRSLLVVCSKYWRVFDAGDYSLLCSGPSENGQTWTGGDFVSSDKVIIWTENGQSYIYKLPASCLPASDSFRSDVGKAVENLIPPVQHILLDRKDKELLICPPVTRFFYGCREYFHKLLIQGDSSGRLNIWNISDTADKQGSEEGLAMTTSISLQEAFDKLNPCPAGIIDQLSVIPNSNEPLKVTASVYIPAHGRLVCGREDGSIVIVPATQTAIVQLLQGEHMLRRGWPPHRTLRGHRNKVTCLLYPHQVSARYDQRYLISGGVDFSVIIWDIFSGEMKHIFCVHGGEITQLLVPPENCSARVQHCICSVASDHSVGLLSLREKKCIMLASRHLFPIQVIKWRPSDDYLVVGCSDGSVYVWQMDTGALDRCVMGITAVEILNACDEAVPAAVDSLSHPAVNLKQAMTRRSLAALKNMAHHKLQTLATNLLASEASDKGNLPKYSHNSLMVQAIKTNLTDPDIHVLFFDVEALIIQLLTEEASRPNTALISPENLQKASGSSDKGGSFLTGKRAAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTEAQLNAVDALIDSMSLA

SEQ ID NO: 751598 - protein, 1457 aa, Homo sapiens
MAGNSLVLPIVLWGRKAPTHCISAVLLTDDGATIVTGCHDGQICLWDLSVELQINPRALLFGHTASITCLSKACASSDKQYIVSASESGEMCLWDVSDGRCIEFTKLACTHTGIQFYQFSVGNQREGRLLCHGHYPEILVVDATSLEVLYSLVSKISPDWISSMSIIRSHRTQEDTVVALSVTGILKVWIVTSEISDMQDTEPIFEEESKPIYCQNCQSISFCAFTQRSLLVVCSKYWRVFDAGDYSLLCSGPSENGQTWTGGDFVSSDKVIIWTENGQSYIYKLPASCLPASDSFRSDVGKAVENLIPPVQHILLDRKDKELLICPPVTRFFYGCREYFHKLLIQGDSSGRLNIWNISDTADKQGSEEGLAMTTSISLQEAFDKLNPCPAGIIDQLSVIPNSNEPLKVTASVYIPAHGRLVCGREDGSIVIVPATQTAIVQLLQGEHMLRRGWPPHRTLRGHRNKVTCLLYPHQVSARYDQRYLISGGVDFSVIIWDIFSGEMKHIFCVHGGEITQLLVPPENCSARVQHCICSVASDHSVGLLSLREKKCIMLASRHLFPIQVIKWRPSDDYLVVGCSDGSVYVWQMDTGALDRCVMGITAVEILNACDEAVPAAVDSLSHPAVNLKQAMTRRSLAALKNMAHHKLQTLATNLLASEASDKGNLPKYSHNSLMVQAIKTNLTDPDIHVLFFDVEALIIQLLTEEASRPNTALISPENLQKASGSSDKGGSFLTGKRAAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTGCLSSVPQMKKISTSYEERRKQATAIVLLGVIGAEFGAEIEPPKLLTRPRSSSQIPEGFGLTSGGSNYSLARHTCKALTFLLLQPPSPKLPPHSTIRRTAIDLIGRGFTVWEPYMDVSAVLMGLLELCADAEKQLANITMGLPLSPAADSARSARHALSLIATARPPAFITTIAKEVHRHTALAANTQSQQNMHTTTLARAKGEILRVIEILIEKMPTDVVDLLVEVMDIIMYCLEGSLVKKKGLQECFPAICRFYMVSYYERNHRIAVGARHGSVALYDIRTGKCQTIHGHKGPITAVAFAPDGRYLATYSNTDSHISFWQMNTSLLGSIGMLNSAPQLRCIKTYQVPPVQPASPGSHNALKLARLIWTSNRNVILMAHDGKEHRFMV

SEQ ID NO: 751599 - protein, 1065 aa, Homo sapiens
MAGNSLVLPIVLWGRKAPTHCISAVLLTDDGATIVTGCHDGQICLWDLSVELQINPRALLFGHTASITCLSKACASSDKQYIVSASESGEMCLWDVSDGRCIEFTKLACTHTGIQFYQFSVGNQREGRLLCHGHYPEILVVDATSLEVLYSLVSKISPDWISSMSIIRSHRTQEDTVVALSVTGILKVWIVTSEISDMQDTEPIFEEESKPIYCQNCQSISFCAFTQRSLLVVCSKYWRVFDAGDYSLLCSGPSENGQTWTGGDFVSSDKVIIWTENGQSYIYKLPASCLPASDSFRSDVGKAVENLIPPVQHILLDRKDKELLICPPVTRFFYGCREYFHKLLIQGDSSGRLNIWNISDTADKQGSEEGLAMTTSISLQEAFDKLNPCPAGIIDQLSVIPNSNEPLKVTASVYIPAHGRLVCGREDGSIVIVPATQTAIVQLLQGEHMLRRGWPPHRTLRGHRNKVTCLLYPHQVSARYDQRYLISGGVDFSVIIWDIFSGEMKHIFCVHGGEITQLLVPPENCSARVQHCICSVASDHSVGLLSLREKKCIMLASRHLFPIQVIKWRPSDDYLVVGCSDGSVYVWQMDTGALDRCVMGITAVEILNACDEAVPAAVDSLSHPAVNLKQAMTRRSLAALKNMAHHKLQTLATNLLASEASDKGNLPKYSHNSLMVQAIKTNLTDPDIHVLFFDVEALIIQLLTEEASRPNTALISPENLQKASGSSDKGGSFLTGKRAAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQGWSQLAAMHCVMLPDLLGLDKFRPPLLEMLARRWQDRCLEVREAAQALLLAELRRIEQAGRKEAIDAWAPYLPQYIDHVISRKSSHASLQSFAGICRKGTCTHKYICYYPSTKMSH

SEQ ID NO: 751600 - protein, 85 aa, Homo sapiens
PGVPVSRDFECPRQFFQKGGVKEALSERELFNAVSGLNITADNEADFLAEIEALEKMNEDHVQKNGRKAASFLKDDGDPPLLYDE

SEQ ID NO: 751601 - protein, 85 aa, Homo sapiens; identical to SEQ ID NO: 751600

SEQ ID NO: 751602 - protein, 85 aa, Homo sapiens; identical to SEQ ID NO: 751600

SEQ ID NO: 751603 - protein, 85 aa, Homo sapiens; identical to SEQ ID NO: 751600

SEQ ID NO: 751604 - protein, 797 aa, Homo sapiens
GRGVAALRRGPGSAPGLPRGRAELRSRVGSGPLPGGAWSAAAAAAAEMMEELHSLDPRRQELLEARFTGVGVSKGPLNSESSNQSLCSVGSLSDKEVETPEKKQNDQRNRKRKAEPYETSQGKGTPRGHKISDYFEFAGGSAPGTSPGRSVPPVARSSPQHSLSNPLPRRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 751605 - protein, 160 aa, Homo sapiens
YPLSEKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKIRLIRLRENGKKKVTKSLPFTVSGITTTTD

SEQ ID NO: 751606 - protein, 797 aa, Homo sapiens; identical to SEQ ID NO: 751604

SEQ ID NO: 751607 - protein, 143 aa, Homo sapiens
GYSNNLYFFFVPGYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 751608 - protein, 797 aa, Homo sapiens; identical to SEQ ID NO: 751604

SEQ ID NO: 751609 - protein, 294 aa, Homo sapiens
GRGVAALRRGPGSAPGLPRGRAELRSRVGSGPLPGGAWSAAAAAAAEMMEELHSLDPRRQELLEARFTGVGVSKGPLNSESSNQSLCSVGSLSDKEVETPEKKQNDQRNRKRKAEPYETSQGKGTPRGHKISDYFEFAGGSAPGTSPGRSVPPVARSSPQHSLSNPLPRRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRVSIKMEE

SEQ ID NO: 751610 - protein, 765 aa, Homo sapiens
GRGVAALRRGPGSAPGLPRGRAELRSRVGSGPLPGGAWSAAAAAAAEMMEELHSLDPRRQELLEARFTGVGVSKGPLNSESSNQSLCSVGSLSDKEVETPEKKQNDQRNRKRKAEPYETSQGKGTPRGHKISDYFERRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 751611 - protein, 797 aa, Homo sapiens; identical to SEQ ID NO: 751604

SEQ ID NO: 751612 - protein, 797 aa, Homo sapiens; identical to SEQ ID NO: 751604

SEQ ID NO: 751613 - protein, 68 aa, Homo sapiens
VSRGSQQMKHMAFIRRCLAYRKEDRIDVQQLACDPYLLPHIRKSVSTSSPAGAAIASTSGASNNSSSN

SEQ ID NO: 751614 - protein, 71 aa, Homo sapiens
VAHASADAWAVLLIETDSKATNCSTHTKWTNGVQQRVWNIANPNGSDETCTRCFYFLAFFPSIEHDSIDSH

SEQ ID NO: 751615 - protein, 119 aa, Homo sapiens
AGHTHFNHPSLLQGKKAKPCVGEEADSNAPDAEERGGYHSITNYHLHATQPGPFQGILDHSPLPWGAMNCRQFNPWAFADSVFSAWNALLHRGSLSRPRSKVSSPVNTCSFSIWYKQPF

SEQ ID NO: 751616 - protein, 216 aa, Homo sapiens
MSAGGDFGNPLRKFKLVFLEDGTIGLRLWDTAGQERLRSLIPRYIRDSAAAVVVYDITNVNSFQQTTKWIDDVRTERGSDVIITLVGNRTDLADKRQVSVEEGERKAKGLNVTFIETRAKTGYNVKQLFRRVAAALPGMESTQDGSREDMSDIKLEKPQEQTVSEGGCSCYSPMSSSTLPQKPPYSFIDCSVNIGLNLFPSLITFCNSSLLPVSWR

SEQ ID NO: 751617 - protein, 254 aa, Homo sapiens
MSAGGDFGNPLRKFKLVFLGEQSVAKTSLITRFRYDSFDNTYQAIIGIDFLSKTMYLEDGTIGLRLWDTAGQERLRSLIPRYIRDSAAAVVVYDITNVNSFQQTTKWIDDVRTERGSDVIITLVGNRTDLADKRQVSVEEGERKAKGLNVTFIETRAKTGYNVKQLFRRVAAALPGMESTQDGSREDMSDIKLEKPQEQTVSEGGCSCYSPMSSSTLPQKPPYSFIDCSVNIGLNLFPSLITFCNSSLLPVSWR

SEQ ID NO: 751618 - protein, 94 aa, Homo sapiens
GWPKNSLDNHLLGTPGCPSSAHSLRPPVSSVTEKRSCSGRRDMLGSTHGQAKLRQSLKLHFDHLLYQIKQNKITPCPPFHTLPSLPSHFPVLTP

SEQ ID NO: 751619 - protein, 296 aa, Homo sapiens
EGPVSPDVEPGKEETEESKKRKRKPYRPGIGGFMVRQRKSHTRTKKGPAAQAEVLSGDGQPDEVIPADLPAEGAVEQSLAEGDEKKKQQRRGRKKSKLEDMFPAYLQEAFFGKELLDLSRKALFAVGVGRPSFGLGTPKAKGDGGSERKELPTSQKGDDGPDIADEESRGLEGKADTPGPEDGGVKASPVPSDPEKPGTPGEGMLSSDLDRISTEELPKMESKDLQQLFKDVLGSEREQHLGCGTPGLEGSRTPLQRPFLQGGLPLGNLPSSSPMDSYPGLCQSPFLDSRERGGFF

SEQ ID NO: 751620 - protein, 92 aa, Homo sapiens
SACASTWSCLPHHSSQRAWLCTEARPVLTHSHAPHHSVPGSPLAGMGSRPVARAKHSLLGQVGKTSPVGASKTQAEAPPAAEAPPATEVSGW

SEQ ID NO: 751621 - protein, 330 aa, Homo sapiens
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 751622 - protein, 338 aa, Homo sapiens
MRTWNSGGTKCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 751623 - protein, 317 aa, Homo sapiens [sequence omitted]

SEQ ID NO: 751624 - protein, 121 aa, Homo sapiens
RREIKSQGKSTMDSFTLIMQTYNRTDLLLKLLNHYQAVPNLHKVIVVWNNIGEKAPDELWNSLGPHPIPVIFKQQTANRMRNRLQVFPELETNGELQCSSQPGKAAAVQSWDRHVNFWPSA

SEQ ID NO: 751625 - protein, 330 aa, Homo sapiens; identical to SEQ ID NO: 751621

SEQ ID NO: 751626 - protein, 275 aa, Homo sapiens
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIILPKPLFGQRTSRGILLKALVKHW

SEQ ID NO: 751627 - protein, 135 aa, Homo sapiens
EKNMKTQGLVRMLTFVCCFHFYSRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNS

SEQ ID NO: 751628 - protein, 507 aa, Homo sapiens
MSCRSYRISSGCGVTRNFSSCSAVAPKTGNRCCISAAPYRGVSCYRGLTGFGSRSLCNLGSCGPRIAVGGFRAGSCGRSFGYRSGGVCGPSPPCITTVSVNESLLTPLNLEIDPNAQCVKQEEKEQIKSLNSRFAAFIDKVRFLEQQNKLLETKWQFYQNQRCCESNLEPLFSGYIETLRREAECVEADSGRLASELNHVQEVLEGYKKKYEEEVALRATAENEFVVLKKDVDCAYLRKSDLEANVEALVEESSFLRRLYEEEIRVLQAHISDTSVIVKMDNSRDLNMDCIIAEIKAQYDDVASRSRAEAESWYRSKCEEMKATVIRHGETLRRTKEEINELNRMIQRLTAEIENAKCQRAKLEAAVAEAEQQGEAALSDARCKLAELEGALQKAKQDMACLLKEYQEVMNSKLGLDIEIATYRRLLEGEEHRLCEGVGSVNVCVSSSRGGVSCGGLSYSTTPGRQITSGPSAIGGSITVVAPDSCAPCQPRSSSFSCGSSRSVRFA

SEQ ID NO: 751629 - protein, 131 aa, Homo sapiens
LFLRQSLALSPRLECNGTISAHCNLCLPGSCNSPASASQVVRITGACHQTQLIFVFFLEMGFRHVGQADLELLTSGDLPALASPSAGITGISHCAQPPIFSISSVLLFSTFFDFTFRFPDLILILLHEFQS

SEQ ID NO: 751630 - protein, 135 aa, Homo sapiens
CKSKGCPEVRAGCPPSSPTIPKRSRHRPLEATLPPRAPVGSICRTSLRGWGRPLLFVFASKLRKSRDWPLQALQFVQVLACGPLLGQPLTFVSLVFQRRKPRVACLGASSCFSMVAKFGINCLVTGWFNDIYLCF

SEQ ID NO: 751631 - protein, 319 aa, Homo sapiens
APGAPWPRRNGDPAASPPSPAQPFRPPRMEAPASAQTPHPHEPISFGIDQILNSPDQDSAPAPRGPDGASYLGGPPGGRPGATYPSLPASFAGLGAPFEDAGSYSVNLSLAPAGVIRVPAHRPLPGAVPPPLPSALPAMPSVPTVSSLGGLNFPWMESSRRFVKDRFTAAAALTPFTVTRRIGHPYQNRTPPKRKKPRTSFSRVQICELEKRFHRQKYLASAERAALAKSLKMTDAQVKTWFQNRRTKWRRQTAEEREADRQQASRLMLQLQHDAFQKSLNDSIQPDPLCLHNSSLFALQNLQPWEEDSSKVPAVTSLV

SEQ ID NO: 751632 - protein, 250 aa, Homo sapiens
APGAPWPRRNGDPAASPPSPAQPFRPPRMEAPASAQTPHPHEPISFGIDQILNSPDQDSAPAPRGPDGASYLGGPPGGRPGATYPSLPASFAGLGAPFEDAGSYSVNLSLAPAGVIRVPAHRPLPGAVPPPLPSALPAMPSVPTVSSLGGLNFPWMESSRRFVKDRFTAAAALTPFTVTRRIGHPYQNRTPPKRKKPRTSFSRVQICELEKRFHRQKYLASAERAALAKSLKMTDAQVKTWFQNRRTKWR

SEQ ID NO: 751633 - protein, 104 aa, Homo sapiens
ATTHELGLQRASVRQELGLRRPSRGGSLARGGHGEARGGPGGHTVEVEAGPLVAVNRQEARPGEADWWSSSGPAEAAESQKQGLGRPPGGMSWAGLKEATGRQE

SEQ ID NO: 751634 - protein, 106 aa, Homo sapiens
AGLWAVPQEKKRLPAHQRVPLALHASRLSHSEPPSATPSPALSVESLSSESASQTAGAELLEPPAVPKSSSEPAVRAPVYSFHLSHYRISDRTLGPSPAPLPTSRM

SEQ ID NO: 751635 - protein, 629 aa, Homo sapiens
GRAPEAAAAWRSGDSKCGPARALPATVPAAPRLALSDLPPGPWGRLRAARGAAGPYPIRGPFPTVPPLPPCSLPPLFLGLYLLFPKSSPLLLPETGPHRLYGGGLVWTRRPEVSRRWLILSVPAAGPEAGAVYTAKPVLLRPVGGALRFPVPSHVAVVSEDDFQHSSNSTYRTTSSSLRADQEALLEKLLDRPPPGLQRPEDRFCGTYIIFFSLGIGSLLPWNFFITAKEYWMFKLRNSSSPATGEDPEGSDILNYFESYLAVASTVPSMLCLVANFLLVNRVAVHIRVLASLTVILAIFMVITALVKVDTSSWTRGFFAVTIVCMVILSGASTVFSSSIYGMTGSFPMRNSQALISGGAMGGTVSAVASLVDLAASSDVRNSALAFFLTATIFLVLCMGLYLLLSRLEYARYYMRPVLAAHVFSGEEELPQDSLSAPSVASRFIDSHTPPLRPILKKTASLGFCVTYVFFITSLIYPAVCTNIESLNKGSGSLWTTKFFIPLTTFLLYNFADLCGRQLTAWIQVPGPNSKALPGFVLLRTCLIPLFVLCNYQPRVHLKTVVFQSDVYPALLSSLLGLSNGYLSTLALLYGPKIVPRELAEATGVVMSFYVCLGLTLGSACSTLLVHLI

SEQ ID NO: 751636 - protein, 489 aa, Homo sapiens
GRAPEAAAAWRSGDMAVVSEDDFQHSSNSTYRTTSSSLRADQEALLEKLLDRPPPGLQRPEDRFCGTYIIFFSLGIGSLLPWNFFITAKEYWMFKLRNSSSPATGEDPEGSDILNYFESYLAVASTVPSMLCLVANFLLVNRVAVHIRVLASLTVILAIFMVITALVKVDTSSWTRGFFAVTIVCMVILSGASTVFSSSIYGMTGSFPMRNSQALISGGAMGGTVSAVASLVDLAASSDVRNSALAFFLTATIFLVLCMGLYLLLSRLEYARYYMRPVLAAHVFSGEEELPQDSLSAPSVASRFIDSHTPPLRPILKKTASLGFCVTYVFFITSLIYPAVCTNIESLNKGSGSLWTTKFFIPLTTFLLYNFADLCGRQLTAWIQVPGPNSKALPGFVLLRTCLIPLFVLCNYQPRVHLKTVVFQSDVYPALLSSLLGLSNGYLSTLALLYGPKIVPRELAEATGVVMSFYVCLGLTLGSACSTLLVHLI

SEQ ID NO: 751637 - protein, 489 aa, Homo sapiens; identical to SEQ ID NO: 751636

SEQ ID NO: 751638 - protein, 292 aa, Homo sapiens
GRAPEAAAAWRSGDSKCGPARALPATVPAAPRLALSDLPPGPWGRLRAARGAAGPYPIRGPFPTVPPLPPCSLPPLFLGLYLLFPKSSPLLLPETGPHRLYGGGLVWTRRPEVSRRWLILSVPAAGPEAGAVYTAKPVLLRPVGGALRFPVPSHVAVVSEDDFQHSSNSTYRTTSSSLRADQEALLEKLLDRPPPGLQRPEDRFCGTYIIFFSLGIGSLLPWNFFITAKEYWMFKLRNSSSPATGEDPEGSDILNYFESYLAVASTVPSMLCLVANFLLVNRLQSTFLCPWP

SEQ ID NO: 751639 - protein, 489 aa, Homo sapiens; identical to SEQ ID NO: 751636

SEQ ID NO: 751640 - protein, 455 aa, Homo sapiens
RAAWRTATWPLSQRTTFSTVQTPPTEPQAAVSELTRRHCLRSCWTARPLACRGPRTASVAHTSSSSAWALAVYCHGTSLSLPRSTGCSNSATPPAQPPGRTLRAQTSWVAVHIRVLASLTVILAIFMVITALVKVDTSSWTRGFFAVTIVCMVILSGASTVFSSSIYGMTGSFPMRNSQALISGGAMGGTVSAVASLVDLAASSDVRNSALAFFLTATIFLVLCMGLYLLLSRLEYARYYMRPVLAAHVFSGEEELPQDSLSAPSVASRFIDSHTPPLRPILKKTASLGFCVTYVFFITSLIYPAVCTNIESLNKGSGSLWTTKFFIPLTTFLLYNFADLCGRQLTAWIQVPGPNSKALPGFVLLRTCLIPLFVLCNYQPRVHLKTVVFQSDVYPALLSSLLGLSNGYLSTLALLYGPKIVPRELAEATGVVMSFYVCLGLTLGSACSTLLVHLI

SEQ ID NO: 751641 - protein, 489 aa, Homo sapiens; identical to SEQ ID NO: 751636

SEQ ID NO: 751642 - protein, 71 aa, Homo sapiens
LPYHLLPLFNSHEAMDQNEVKTKERKHTVSLRHVSSVKDYVNHPPPLKALDLIHTFKLSFRNGFGYTDVIR

SEQ ID NO: 751643 - protein, 330 aa, Homo sapiens
MQQQPLPGPGAPTTEPTKPPYSYIALIAMAIQSSPGQRATLSGIYRYIMGRFAFYRHNRPGWQNSIRHNLSLNECFVKVPRDDRKPGKGSYWTLDPDCHDMFEHGSFLRRRRRFTRQTGAEGTRGPAKARRGPLRATSQDPGVPNATTGRQCSFPPELPDPKGLSFGGLVGAMPASMCPATTDGRPRPPMEPKEISTPKPACPGELPVATSSSSCPAFGFPAGFSEAESFNKAPTPVLSPESGIGSSYQCRLQALNFCMGADPGLEHLLASAAPSPAPPTPPGSLRAPLPLPTDHKEPWVAGGFPVQGGSGYPLGLTPCLYRTPGMFFFE

SEQ ID NO: 751644 - protein, 330 aa, Homo sapiens; identical to SEQ ID NO: 751643

SEQ ID NO: 751645 - protein, 102 aa, Homo sapiens
MKKESKKEREKERKKGRKEGRKERKRKERKRKERRKERRKERKKEERERKEGRKERKKERQTKKERQEGRKKGKKERKRKEGKKEGGEEGRKKERKIHYSVL

SEQ ID NO: 751646 - protein, 160 aa, Homo sapiens
SVPHRFAVKEGKKERREGEEGRKKGKKERKTDKERKTGRKEERKERKKKEGRKEGRRGRRKKEGKKDSLFCPLNLSEEKYPVLCTCVKREKKRKEKKERKKEKKDRKEERKERKKERKKKRQTGRKKGKKERKGKEGRKEGRKEERRKERRFIILSSEPE

SEQ ID NO: 751647 - protein, 87 aa, Homo sapiens
NSTACGSAPRNHLHKIAPPLGTLPSGTSPRDSTPCGPASFTRDLAPRDVRGAVAPPTWSSGGVELSPLWPRPGRVLGLNPGGDLGGN

SEQ ID NO: 751648 - protein, 393 aa, Homo sapiens
MNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPWELDCAMLRRLEKRILVDLPSREARQAMIYHWLPPVSKSRALELHTELEYSVLSQETEGYSGSDIKLVCREAAMRPVRKIFDALENHQSESSDLPRIQLDIVTTADFLDVLTHTKPSAKNLAQRYSDWQREFESV

SEQ ID NO: 751649 - protein, 486 aa, Homo sapiens
MRTEARRKNLLILISHYLTQEGYIDTANALEQETKLGLRRFEVCDNIDLETILMEYESYYFVKFQKYPKIVKKSSDTAENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPWELDCAMLRRLEKRILVDLPSREARQAMIYHWLPPVSKSRALELHTELEYSVLSQETEGYSGSDIKLVCREAAMRPVRKIFDALENHQSESSDLPRIQLDIVTTADFLDVLTHTKPSAKNLAQRYSDWQREFESV

SEQ ID NO: 751650 - protein, 532 aa, Homo sapiens
ASGSLDRPVSPVTDYFSPFSRVLAQCLMELSYQTLKFTHQAREACEMRTEARRKNLLILISHYLTQEGYIDTANALEQETKLGLRRFEVCDNIDLETILMEYESYYFVKFQKYPKIVKKSSDTAENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPWELDCAMLRRLEKRILVDLPSREARQAMIYHWLPPVSKSRALELHTELEYSVLSQETEGYSGSDIKLVCREAAMRPVRKIFDALENHQSESSDLPRIQLDIVTTADFLDVLTHTKPSAKNLAQRYSDWQREFESV

SEQ ID NO: 751651 - protein, 352 aa, Homo sapiens
MRTEARRKNLLILISHYLTQEGYIDTANALEQETKLGLRRFEVCDNIDLETILMEYESYYFVKFQKYPKIVKKSSDTAENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPW

SEQ ID NO: 751652 - protein, 154 aa, Homo sapiens
RVETTFWDFIHPTRLFKKTVWVPYKYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPW

SEQ ID NO: 751653 - protein, 433 aa, Homo sapiens
MEYESYYFVKFQKYPKIVKKSSDTAENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPWELDCAMLRRLEKRILVDLPSREARQAMIYHWLPPVSKSRALELHTELEYSVLSQETEGYSGSDIKLVCREAAMRPVRKIFDALENHQSESSDLPRIQLDIVTTADFLDVLTHTKPSAKNLAQRYSDWQREFESV

SEQ ID NO: 751654 - protein, 433 aa, Homo sapiens
MRTEARRKNLLILISHYLTQEGYIDTANALEQETKLGLRRFEVCDNIDLETILMEYESYYFVKFQKYPKIVKKSSDTAENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPCLKAIALQPGDRARLRLKKKKSVLVHFHAAGEDISKTGKKKKLTGLTVSHGWGASESWRGAKDTSYMVAARENEEDARSGNP

SEQ ID NO: 751655 - protein, 67 aa, Homo sapiens
HVSVQPQNKATGEGLMGSTEDTVAHTWLDYLLKVASVTFHSDHALPAAPSLQPTWLCGLLLIYALQD

SEQ ID NO: 751656 - protein, 422 aa, Homo sapiens
MCAPPRGAPPEHPAPTGLCRSSCAELQARVMAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPAAPLPGFSAVVVSSVPLGGGLSSSASLEVATYTFLQQLCPDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 751657 - protein, 345 aa, Homo sapiens
MCAPPRGAPPEHPAPTGLCRSSCAELQARVMAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPAAPLPGFSAVVVSSVPLGGGLSSSASLEVATYTFLQQLCPDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTAQAAAALRRGDYRAFGRLMVESHRSLR

SEQ ID NO: 751658 - protein, 410 aa, Homo sapiens
MRKPKRWLPKQAAWGARVMAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPAAPLPGFSAVVVSSVPLGGGLSSSASLEVATYTFLQQLCPDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 751659 - protein, 574 aa, Homo sapiens
MCAPPRGAPPEHPAPTGLCRSSCAELQARVMAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPGRGPGLSQVLTDTRSATSQPQSPFICLITVGKACRVEHPIVQMRKLMPPEGRELALGFPGPDWRSQDLNPSLFSLQSPKPGGQLEVSQQTSEGGKMEGSGSLGPAGWWLLTIETHTLETAARPLLPFPPGHLPFLCHPPRQPLLPSPVLSPAAAPLPGFSAVVVSSVPLGGGLSSSASLEVATYTFLQQLCPDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 751660 - protein, 433 aa, Homo sapiens
MCAPPRGAPPEHPAPTGLCRSSCAELQARVMAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPAAPLPGFSAVVVSSVPLGGGLSSSASLEVATYTFLQQLCPALASPPHPVLQDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 751661 - protein, 182 aa, Homo sapiens
MCAPPRGAPPEHPAPTGLCRSSCAELQARVMAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPAAPLPGFSAVVVSSHPWKWPRTPSSSSSVQTRAQ

SEQ ID NO: 751662 - protein, 387 aa, Homo sapiens
GVSHCARPNLSVFISTYSECQVTLLETGDQRLMTSHSCWPWGPRGSLWESQVNRVPAPLLWLCGWWWVVRHIESHQRQGRAAQKSWSCQVPLRAILTLVSAHWFFPKSRGKDTIGGAVSHPAPLAPATHHPAAGFPRELRVGAEPAEVWGRGVRARGGAGGNVRTPARGPARASRADGAVPEQLCRAAGARHGCFETAPGRGAAGRGPASLPGGVRGRARAGRVSAGPRQPHRGTHGLQPGPGAAYGEGLHGEPLARRRLSRPPRRAGLGDAGGEFFPREMWGGQLRLEHRCTEESPGQAVPHVEGRKRGSGRERVRGRLLAQARPLGAGAPRLQPGSMFPLNCEALCATQKGTLRASGHRGAPTADLGERSLLAQPVQFTEEETEA

SEQ ID NO: 751663 - protein, 345 aa, Homo sapiens; identical to SEQ ID NO: 751657

SEQ ID NO: 751664 - protein, 338 aa, Homo sapiens
MALELMTVLVGSPRKDGLVSLLTTSEGADEPQRLQFPLPTAQRSLEPGTPRWANYVKGVIQYYPAAPLPGFSAVVVSSVPLGGGLSSSASLEVATYTFLQQLCPDSGTIAARAQVCQQAEHSFAGMPCGIMDQFISLMGQKGHALLIDCRSLETSLVPLSDPKLAVLITNSNVRHSLASSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 751665 - protein, 392 aa, Homo sapiens
MCAPPRGAPPEHPAPTGLCRSSCAELQARVMAALRQPQVAELLAEARRAFREEFGAEPELAVSAPGRVNLIGEHTDYNQGLVLPMALELMTVLVGSPRKDGLVSLLTTSEGADEPQRLQFPLPTAQRSLEPGTPRWANYVKGVIQYYPAAPLPGFSAVVVSSVPLGGGLSSSASLEVATYTFLQQLCPDSGTIAARAQVCQQAEHSFAGMPCGIMDQFISLMGQKGHALLIDCSEYPVRRRQCEEVARALGKESLREVQLEELEAARDLVSKEGFRRARHVVGEIRRTAQAAAALRRGDYRAFGRLMVESHRSLRDDYEVSCPELDQLVEAALAVPGVYGSRMTGGGFGGCTVTLLEASAAPHAMRHIQEHYGGTATFYLSQAADGAKVLCL

SEQ ID NO: 751666 - protein, 213 aa, Homo sapiens [sequence omitted]

SEQ ID NO: 751667 - protein, 710 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEKRLMFSHPAFNQLCEHMMREAKIMQYKYLLFSLHAIVKLGIPQNTILVQTLLRVTQERINECDEICLSVLSTVLEAMEPCKNVHVLRTGFRILVDQQVWKIEDVFTLQVVMKCIGKDAPIALKRKLEMKALRELDRFSVLNSQHMFEVLAAMNHRSLILLDECSKVVLDNIHGCPLRIMINILQSCKDLQYHNLDLFKGLADYVAATFDIWKFRKVLFILILFENLGFRPVGLMDLFMKRIVEDPESLNMKNILSILHTYSSLNHVYKCQNKEQFVEVMASALTGYLHTISSENLLDAVYSFCLMNYFPLAPFNQLLQKDIISELLTSDDMKNAYKLHTLDTCLKLDDTVYLRDIALSLPQLPRELPSSHTNAKVAEVLSSLLGGEGHFSKDVHLPHNYHIDFEIRMDTNRNQVLPLSDVDTTSATDIQRVAVLCVSRSAYCLGSSHPRGFLAMKMRHLNAMGFHVILVNNWEMDKLEMEDAVTFLKTKIYSVEALPVAAVNVQSTQ

SEQ ID NO: 751668 - protein, 648 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEKRLMFSHPAFNQLCEHMMREAKIMQYKYLLFSLHAIVKLGIPQNTILVQTLLRVTQERINECDEICLSVLSTVLEAMEPCKNVHVLRTGFRILVDQQVWKIEDVFTLQVVMKCIGKDAPIALKRKLEMKALRELDRFSVLNSQHMFEVLAAMNHRSLILLDECSKVVLDNIHGCPLRIMINILQSCKDLQYHNLDLFKGLADYVAATFDIWKFRKVLFILILFENLGFRPVGLMDLFMKRIVEDPESLNMKNILSILHTYSSLNHVYKCQNKEQFVEVMASALTGYLHTISSENLLDAVYSFCLMNYFPLAPFNQLLQKDIISELLTSDDMKNAYKLHTLDTCLKLDDTVYLRDIALSLPQLPRELPSSHTNAKVAEVLSSLLGGEGHFSKDVHLPHNYHIDFEIRMDTNRNQVLPLSDVDTTSATDIQRLLTYISFAGLSELKS

SEQ ID NO: 751669 - protein, 648 aa, Homo sapiens; identical to SEQ ID NO: 751668

SEQ ID NO: 751670 - protein, 710 aa, Homo sapiens; identical to SEQ ID NO: 751667

SEQ ID NO: 751671 - protein, 692 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEREAKIMQYKYLLFSLHAIVKLGIPQNTILVQTLLRVTQERINECDEICLSVLSTVLEAMEPCKNVHVLRTGFRILVDQQVWKIEDVFTLQVVMKCIGKDAPIALKRKLEMKALRELDRFSVLNSQHMFEVLAAMNHRSLILLDECSKVVLDNIHGCPLRIMINILQSCKDLQYHNLDLFKGLADYVAATFDIWKFRKVLFILILFENLGFRPVGLMDLFMKRIVEDPESLNMKNILSILHTYSSLNHVYKCQNKEQFVEVMASALTGYLHTISSENLLDAVYSFCLMNYFPLAPFNQLLQKDIISELLTSDDMKNAYKLHTLDTCLKLDDTVYLRDIALSLPQLPRELPSSHTNAKVAEVLSSLLGGEGHFSKDVHLPHNYHIDFEIRMDTNRNQVLPLSDVDTTSATDIQRVAVLCVSRSAYCLGSSHPRGFLAMKMRHLNAMGFHVILVNNWEMDKLEMEDAVTFLKTKIYSVEALPVAAVNVQSTQ

SEQ ID NO: 751672 - protein, 552 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEKRLMFSHPAFNQLCEHMMREAKIMQYKYLLFSLHAIVKLGIPQNTILVQTLLRVTQERINECDEICLSVLSTVLEAMEPCKNVHVLRTGFRILVDQQVWKIEDVFTLQVVMKCIGKDAPIALKRKLEMKALRELDRFSVLNSQHMFEVLAAMNHRSLILLDECSKVVLDNIHGCPLRIMINILQSCKDLQYHNLDLFKGLADYVAATFDIWKFRKVLFILILFENLGFRPVGLMDLFMKRIVEDPESLNMKNILSILHTYSSLNHVYKCQNKEQFVEVMASALTGYLHTISSENLLDAVYSFCLMNYFPLAPFNQLLQKDIISELLTSDDMKNAYNCHRHIQMQRWQRC

SEQ ID NO: 751673 - protein, 255 aa, Homo sapiens
LRRGQRPDRYSGERHPPPPYPQFVEVMASALTGYLHTISSENLLDAVYSFCLMNYFPLAPFNQLLQKDIISELLTSDDMKNAYKLHTLDTCLKLDDTVYLRDIALSLPQLPRELPSSHTNAKVAEVLSSLLGGEGHFSKDVHLPHNYHIDFEIRMDTNRNQVLPLSDVDTTSATDIQRVAVLCVSRSAYCLGSSHPRGFLAMKMRHLNAMGFHVILVNNWEMDKLEMEDAVTFLKTKIYSVEALPVAAVNVQSTQ

SEQ ID NO: 751674 - protein, 200 aa, Homo sapiens
PLRLGTRPGGEKDIISELLTSDDMKNAYKLHTLDTCLKLDDTVYLRDIALSLPQLPRELPSSHTNAKVAEVLSSLLGGEGHFSKDVHLPHNYHIDFEIRMDTNRNQVLPLSDVDTTSATDIQRVAVLCVSRSAYCLGSSHPRGFLAMKMRHLNAMGFHVILVNNWEMDKLEMEDAVTFLKTKIYSVEALPVAAVNVQSTQ

SEQ ID NO: 751675 - protein, 309 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEKRLMFSHPAFNQLCEHMMREAKIMQYKYLLFSLHAIVKLGIPQNTILVQTLLRVTQERINECDEICLSVLSTVLEAMEPCKNVHVLRTGFRILVDQQVWKIEDVFT

SEQ ID NO: 751676 - protein, 677 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEKRLMFSHPAFNQLCEHMMREAKIMQYKYLLFSLHAIVKLGIPQNTILVQTLLRVTQERINECDEICLSVLSTVLEAMEPCKNVHVLRTGFRILVDQQVWKIEDVFTLQVVMKCIGKDAPIALKRKLEMKALRELDRFSVLNSQHMFEVLAAMNHRSLILLDECSKVVLDNIHGCPLRIMINILQSCKDLQYHNLDLFKGLADYVAATFDIWKFRKVLFILILFENLGFRPVGLMDLFMKRIVEDPESLNMKNILSILHTYSSLNHVYKCQNKEQFVEVMASALTGYLHTISSENLLDAVYSFCLMNYFPLAPFNQLLQKDIISELLTSDDMKNAYKLHTLDTCLKLDDTVYLRDIALSLPQLPRELPSSHTNAKVAEVLSSLLGGEGHFSKDVHLPHNYHIDFEIRMDTNRNQVLPLSDVDTTSATDIQRVAVLCVSRSAYCLGSSHPRGFLAMKMRHLNAMGFHVILVRKKCK

SEQ ID NO: 751677 - protein, 552 aa, Homo sapiens; identical to SEQ ID NO: 751672

SEQ ID NO: 751678 - protein, 522 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEKRLMFSHPAFNQLCEHMMREAKIMQYKYLLFSLHAIVKLGIPQNTILVQTLLRVTQERINECDEICLSVLSTVLEAMEPCKNVHVLRTGFRILVDQQVWKIEDVFTLQVVMKCIGKDAPIALKRKLEMKALRELDRFSVLNSQHMFEVLAAMNHRSLILLDECSKVVLDNIHGCPLRIMINILQSCKDLQYHNLDLFKGLADYVAATFDIWKFRKVLFILILFENLGFRPVGLMDLFMKRIVEDPESLNMKNILSILHTYSSLNHVYKCQNKEQFVEVMASALTGYLHTISSENLLDAVYSFCLMNYFPLACQYPKDLE

SEQ ID NO: 751679 - protein, 110 aa, Homo sapiens
NWLLNSQTFIINIFSNLETTVSGNNDQRNIDVTGTSRRSTILTGNTSYSEILSHAYQVCKIQLGQGCRRPPLMLVGEGDYGRKHALPQHCLCSSISKKRTFDTYQKTRPL

SEQ ID NO: 751680 - protein, 584 aa, Homo sapiens
MANEDCPKAADSPFSSDKHAQLILAQINKMRNGQHFCDVQLQVGQESFKAHRLVLAASSPYFAALFTGGMKESSKDVVPILGIEAGIFQILLDFIYTGIVNIGVNNVQELIIAADMLQLTEVVHLCCEFLKGQIDPLNCIGIFQFSEQIACHDLLEFSENYIHVHFLEVHSGEEFLALTKDQLIKILRSEELSIEDEYQVFLAAMQWILKDLGKRRKHVVEVLDPIRFPLLPPQRLLKYIEGVSDFNLRVALQTLLKEYCEVCKSPKENKFCSFLQTSKVRPRKKARKYLYAVGGYTRLQGGRWSDSRALSCVERFDTFSQYWTTVSSLHQARSGLGVTVLGGMVYAIGGEKDSMIFDCTECYDPVTKQWTTVASMNHPRCGLGVCVCYGAIYALGGWVGAEIGNTIERFDPDENKWEVVGNMAVSRYYFGCCEMQGLIYVIGGISNEGIELRSFEVYDPLSKRWSPLPPMGTRRAYLGVAALNDCIYSVGGWNETQDALHTVEKYSFEEEKWVEVASMKVPRAGMCVVAVNGLLYVSGGRSSSHDFLAPGTLDSVEVYNPHSDTWTEIGNMITSRCEGGVAVL

SEQ ID NO: 751681 - protein, 584 aa, Homo sapiens; identical to SEQ ID NO: 751680

SEQ ID NO: 751682 - protein, 584 aa, Homo sapiens; identical to SEQ ID NO: 751680

SEQ ID NO: 751683 - protein, 143 aa, Homo sapiens
SSHSLASGCPVFRGGEGTGARSTPLALLLDPKARPDPFIPWGAPASAIGMRSLKSLHKQVRDPPTCRSWATPRAIPRGCGRTQPPTDRRPESSEGAIPIPTSGEARTAIVASGKTQLEPNGPCPHCNCAENVSQMTQIGSYFF

SEQ ID NO: 751684 - protein, 72 aa, Homo sapiens
IGRQAQAGVEAPSLLHAPLSHGTLLTKHTLKNKITKNFKMVSIGHYTWSVESYVTTLVTYPQGPALPWFRDT

SEQ ID NO: 751685 - protein, 245 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKT

SEQ ID NO: 751686 - protein, 245 aa, Homo sapiens; identical to SEQ ID NO: 751685

SEQ ID NO: 751687 - protein, 83 aa, Homo sapiens
KTLVHTQTLFSSNGELDPWSGGGVTKDITDTLVAVTISEGAHHLDLRTKNALDPMSVLLARSLEVRHMKNWIRDFYDSAGKQH

SEQ ID NO: 751688 - protein, 83 aa, Homo sapiens; identical to SEQ ID NO: 751687

SEQ ID NO: 751689 - protein, 83 aa, Homo sapiens
AHTIFIKQSGESAVAVRSFQDPACGQLPAAAAHSQPQLTPRPSVSPGLDQSTGTILWVHPSMASFQETLDPGWGSGRLSPPCF

SEQ ID NO: 751690 - protein, 75 aa, Homo sapiens
FSVLACFQAADKDIPETGQFTKERGLIGLTVPRGGGRLTIMSEGKEEQVKSHVEGSRQRGNLCRETPIFQNHQIL

SEQ ID NO: 751691 - protein, 213 aa, Homo sapiens
PSFSGLPPWLLPDVRLVPDELLSALALSPARMDATGDCELQLPHLRLHPLCPCSPSHPASFSLWGVQRDSGKAGGSRRGFLGNLSTVISLLSCRYRVKCDGEGGYWCPFHSCAKESRWNLNLAEAATQDGFQRTFSRMAPPPLLPLPPSREGLFWVYSCLPCTTSPYLANSFVHSFIHSFIPHKSAEHLPCPRPLNTEVNETDMLPALKLLIV

SEQ ID NO: 751692 - protein, 168 aa, Homo sapiens
MPQCGPQKTQPHKQTKKKPNNKQGERTKDAPKGPKITSTQLLYKGPQERPRNNSSDETRQTITHANKANTGKENTVEKHHHTAGRQIATHTTEDNTEGKIKTQARITRGQPTAKATKQRRQRARRPAPRHYTASEKIPREAARAAHRKQATQRETRAAHTPRRETHNY

SEQ ID NO: 751693 - protein, 220 aa, Homo sapiens
MERYAGALEEVADGARQQERHYQLLSALQSLVKELPSSFQQRLSYTTLSDLALALLDGTVFEIVQGLLEIQHLTEKSLYNQRLRLQNEHRVLRQALRQKHQEAQQACRPHNLPVLQAAQQRELEAVEHRIREEQRAMDQKIVLELDRKVADQQSTLEKAGVAGFYVTTNPQELMLQMNLLELIRKLQQRGCWAGKAALGLGGPWQLPAAQCDQKGSPVPP

SEQ ID NO: 751694 - protein, 144 aa, Homo sapiens
MERYAGALEEVADGARQQERHYQLLSALQSLVKELPSSFQQRLSYTTLSDLALALLDGTVFEIVQGLLEIQHLTEKSLYNQRLRLQNEHRGARGQREEVPPPRGRRLPAALGICAARLLPWECSEEVPKINKIKGAETETAPFW

SEQ ID NO: 751695 - protein, 364 aa, Homo sapiens
IWYNYSCFIFYYTGTARVLGLLPQRLGGLPPTPATRSSPAPAQQLVWGAGRGQSGLAVPAGGWAPRGDHGRPRWGLRFQLSWPRGSRVVLSVSLRGQRGRRQTPTPLLGRDGALDPGPVGSGPRPLPLGRPVTGTVHLAGAPARSPDLSPNDSARAGGILHGPAISRRRSLASKVARGAGSSFQQRLSYTTLSDLALALLDGTVFEIVQGLLEIQHLTEKSLYNQRLRLQNEHRVLRQALRQKHQEAQQACRPHNLPVLQAAQQRELEAVEHRIREEQRAMDQKIVLELDRKVADQQSTLEKAGVAGFYVTTNPQELMLQMNLLELIRKLQQRGCWAGKAALGLGGPWQLPAAQCDQKGSPVPP

SEQ ID NO: 751696 - protein, 138 aa, Homo sapiens
MCPTSFVFMLRQALRQKHQEAQQACRPHNLPVLQAAQQRELEAVEHRIREEQRAMDQKIVLELDRKVADQQSTLEKAGVAGFYVTTNPQELMLQMNLLELIRKLQQRGCWAGKAALGLGGPWQLPAAQCDQKGSPVPP

SEQ ID NO: 751697 - protein, 260 aa, Homo sapiens
MERYAGALEEVADGARQQERHYQLLSALQSLVKELPSSFQQRLSYTTLSDLALALLDGTVFEIVQGLLEIQHLTEKSLYNQRLRLQNEHRVPRTFWNPLETCRDSGVGEMEEAGVLPSADTPLAWLLCWVVLRQALRQKHQEAQQACRPHNLPVLQAAQQRELEAVEHRIREEQRAMDQKIVLELDRKVADQQSTLEKAGVAGFYVTTNPQELMLQMNLLELIRKLQQRGCWAGKAALGLGGPWQLPAAQCDQKGSPVPP

SEQ ID NO: 751698 - protein, 151 aa, Homo sapiens
IWYNYSCFIFYYTGTARVLGLLPQRLGGLPPTPATRSSPAPAQQLVWGAGRGQSGLAVPAGGWAPRGDHGRPRWGLRFQLSWPRGSRVVLSVSLRGQRGRRQTPTPLLGRDGALDPGPVGSGPRPLPLGRPVTGTVHLAGAPARSPDLSPQ

SEQ ID NO: 751699 - protein, 70 aa, Homo sapiens
WSYRTSYLIGNGQLQMTNNPQELMLQMNLLELIRKLQQRGCWAGKAALGLGGPWQLPAAQCDQKGSPVPP

SEQ ID NO: 751700 - protein, 224 aa, Homo sapiens
VRDIPKEPRLGTSPVADGARQQERHYQLLSALQSLVKELPSSFQQRLSYTTLSDLALALLDGTVFEIVQGLLEIQHLTEKSLYNQRLRLQNEHRVLRQALRQKHQEAQQACRPHNLPVLQAAQQRELEAVEHRIREEQRAMDQKIVLELDRKVADQQSTLEKAGVAGFYVTTNPQELMLQMNLLELIRKLQQRGCWAGKAALGLGGPWQLPAAQCDQKGSPVPP

SEQ ID NO: 751701 - protein, 144 aa, Homo sapiens; identical to SEQ ID NO: 751694

SEQ ID NO: 751702 - protein, 220 aa, Homo sapiens; identical to SEQ ID NO: 751693

SEQ ID NO: 751703 - protein, 220 aa, Homo sapiens; identical to SEQ ID NO: 751693

SEQ ID NO: 751704 - protein, 138 aa, Homo sapiens
MKGLLPLAWFLACSVPAVQGGLLDLKSMIEKVTGKNALTNYGFYGCYCGWGGRGTPKDGTDWCCWAHDHCYGRLEEKGCNIRTQSYKYRFAWGVVTCEPGPFCHVNLCACDRKLVYCLKRNLRSYNPQYQYFPNILCS

SEQ ID NO: 751705 - protein, 138 aa, Homo sapiens; identical to SEQ ID NO: 751704

SEQ ID NO: 751706 - protein, 151 aa, Homo sapiens
QGSTRLGPGRSFSSPPPGLSSSSVTPIHSFKILEAKNLTPPGSMAVDTNVPTGDGEPARPGSPGSAQGSCSWEQTSRAGFEARPKRTPEMKGLLPLAWFLACSVPAVQGGLLDLKSMIEKVTGKNALTNYGFYGCYCGWGGRGTPKDGTDW

SEQ ID NO: 751707 - protein, 108 aa, Homo sapiens
MELSPRKHLSRARLQLTVGPQSSLYPGRATGGLGNHLTPGLDPTPKGKTSLPHPFVLLWFPDCQWGSTSFGSHWKLRDETEKKPKQQRSAQVWKCPQPALPFPPGRAA

SEQ ID NO: 751708 - protein, 341 aa, Homo sapiens
MEPAFGEVNQLGGVFVNGRPLPNAIRLRIVELAQLGIRPCDISRQLRVSHGCVSKILARYNETGSILPGAIGGSKPRVTTPTVVKHIRTYKQRDPGIFAWEIRDRLLADGVCDKYNVPSVSSISRILRNKIGNLAQQGHYDSYKQHQPTPQPALPYNHIYSYPSPITAAAAKVPTPPGVPAIPGSVAMPRTWPSSHSVTDILGIRSITDQVSDSSPYHSPKVEEWSSLGRNNFPAAAPHAVNGLEKGALEQEAKYGQAPNGLPAVGSFVSASSMAPYPTPAQVSPYMTYSAAPSGYVAGHGWQHAGGTSLSPHNCDIPASLAFKGMQAAREGSHSVTASAL

SEQ ID NO: 751709 - protein, 341 aa, Homo sapiens; identical to SEQ ID NO: 751708

SEQ ID NO: 751710 - protein, 176 aa, Homo sapiens
AAKVPTPPGVPAIPGSVAMPRTWPSSHSVTDILGIRSITDQGRGSEAGRVDVQRLPPHSRGGPSICSLRDTVFPPPEAFSFGNVRSLPRGCSDLINLKLMPLVSLPHTVFCLISNYQTHNIPPSPTHGSHFPPSPASRAEAASARLAHLESAAGAGLGAQPGRPEPAWGCRLQTPL

SEQ ID NO: 751711 - protein, 107 aa, Homo sapiens
PGIRVLCETLQHPGCNIRRLWLGRCGLSHECCFDISLVLSSNQKLVELDLSDNALGDFGIRLLCVGLKHLLCNLKKLWLVSCCLTSACCQDLASVLSTCHFLTRLYV

SEQ ID NO: 751712 - protein, 717 aa, Homo sapiens
MASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKLYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWHKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHG

SEQ ID NO: 751713 - protein, 919 aa, Homo sapiens
MASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKLYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWHKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLGRCGLSHECCFDISLVLSSNQKLVELDLSDNALGDFGIRLLCVGLKHLLCNLKKLWLVNSALRQSVVQLCPRYSALIRISRTFTARQHSRRQGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 751714 - protein, 717 aa, Homo sapiens; identical to SEQ ID NO: 751712

SEQ ID NO: 751715 - protein, 919 aa, Homo sapiens; identical to SEQ ID NO: 751713

SEQ ID NO: 751716 - protein, 193 aa, Homo sapiens
DAPARLPTVPFLIHLVATLLPPGTRRGQPHLQCPCRTPKLRQGREPQKAEWDSGWGGGQGRAGLFPAASKGCIKCEAPCPEDWLLYGRKCYFFSEEPRDWNTGRQYCHTHEAVLAVIQSQKELEFMFKFTRREPWIGLRRVGDEFHWVNGDPFDPDTFTIAGPGECVFVEPTRLVSTECLMTRPWVCSKMAYT

SEQ ID NO: 751717 - protein, 339 aa, Homo sapiens
MSSEMLPAFIETSNVDKKQGINEDQEESQKPRLGEGCEPISKRQMKKLIKQKQWEEQRELRKQKRKEKRKRKKLERQCQMEPNSDGHDRKRVRRDVVHSTLRLIIDCSFDHLMVLKDIKKLHKQIQRCYAENRRALHPVQFYLTSHGGQLKKNMDENDKGWVNWKDIHIKPEHYSELIKKEDLIYLTSDSPNILKELDESKAYVIGGLVDHNHHKGLTYKQASDYGINHAQLPLGNFVKMNSRKVLAVNHVFEIILEYLETRDWQEAFFTILPQRKGAVPTDKACESASHDNQSVRMEEGGSDSDSSEEEYSRNELDSPHEEKQDKENHTESTVNSLPH

SEQ ID NO: 751718 - protein, 339 aa, Homo sapiens; identical to SEQ ID NO: 751717

SEQ ID NO: 751719 - protein, 339 aa, Homo sapiens; identical to SEQ ID NO: 751717

SEQ ID NO: 751720 - protein, 186 aa, Homo sapiens [sequence omitted]

SEQ ID NO: 751721 - protein, 339 aa, Homo sapiens; identical to SEQ ID NO: 751717

SEQ ID NO: 751722 - protein, 385 aa, Homo sapiens
RKKKTKNTQETKPKNPKKKTDNNPKKHSFKKSLPCQHFNSFQRHQIMSSEMLPAFIETSNVDKKQGINEDQEESQKPRLGEGCEPISKRQMKKLIKQKQWEEQRELRKQKRKEKRKRKKLERQCQMEPNSDGHDRKRVRRDVVHSTLRLIIDCSFDHLMVLKDIKKLHKQIQRCYAENRRALHPVQFYLTSHGGQLKKNMDENDKGWVNWKDIHIKPEHYSELIKKEDLIYLTSDSPNILKELDESKAYVIGGLVDHNHHKGLTYKQASDYGINHAQLPLGNFVKMNSRKVLAVNHVFEIILEYLETRDWQEAFFTILPQRKGAVPTDKACESASHDNQSVRMEEGGSDSDSSEEEYSRNELDSPHEEKQDKENHTESTVNSLPH

SEQ ID NO: 751723 - protein, 118 aa, Homo sapiens
MSSEMLPAFIETSNVDKKQGINEDQEESQKPRLGEGCEPISKRQMKKLIKQKQWEEQRELRKQKRKEKRKRKKLERQCQMEPNSDGHDRKRVRRDVVHSTLRLIIDCSFDHLMVLKVS

SEQ ID NO: 751724 - protein, 376 aa, Homo sapiens
MFPRPLTPLAAPNGAEPLGRALRRAPLGRARAGLGGPPLLLPSMLMFAVIVASSGLLLMIERGILAEMKPLPLHPPGREGTAWRGKAPKPGGLSLRAGDADLQVRQDVRNRTLRAVCGQPGMPRDPWDLPVGQRRTLLRHILVSDRYRFLYCYVPKVACSNWKRVMKVLAGVLDSVDVRLKMDHRSDLVFLADLRPEEIRYRLQHYFKFLFVREPLERLLSAYRNKFGEIREYQQRYGAEIVRRYRAGAGPSPAGDDVTFPEFLRYLVDEDPERMNEHWMPVYHLCQPCAVHYDFVGSYERLEADANQVLEWVRAPPHVRFPARQAWYRPASPESLHYHLCSAPRALLQDVLPKYILDFSLFAYPLPNVTKEACQQ

SEQ ID NO: 751725 - protein, 77 aa, Homo sapiens
QPGCSIPSAHIHLVLPPCPLLSPDARAPESSHACSVQPPHWLPGKGDNVSRLSECTSLCTEYSNTESFLCDDLCFAL

SEQ ID NO: 751726 - protein, 127 aa, Homo sapiens
PLSHPLQSFFSSFTPSSSVSLQPLLVISESLSTSAFLSHCLFLPLILWDSHSLNTNGRDLLCPMAQLSSAPQLCHHLPLPEGTRMALCKDSHQECQSQRLRDQRTQKGDLKNSCLGAGPGGSDFSGY

SEQ ID NO: 751727 - protein, 70 aa, Homo sapiens
MYLFLSQESSFPRNPRGSHAYLPLVIIQISPIIRASRLPYTWMYNPHTAFFIPSETYFSPKFLSPPSTDT

SEQ ID NO: 751728 - protein, 42 aa, Homo sapiens
MGMEGGKKCESSSVAESKWLGLCSQRLSEKEELLADLEEVKN

SEQ ID NO: 751729 - protein, 163 aa, Homo sapiens
MDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEGSCSCLCLWVMSTTLPASPTPWNPHWCAVHRFVNSW

SEQ ID NO: 751730 - protein, 144 aa, Homo sapiens
MDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 751731 - protein, 193 aa, Homo sapiens
LAPLPASRGFFPRPRTLTPCDLDSHGGTRAHTSSCCGAESPPLRVFVPASETPARPQHFRPREPRVRAGQRLPGPGRLLPGPGRAAAAEPGAPPSSRRRRSRCRSGFPSPPPRPPRASSRRAAGREGSGHRGPLPAAGLPRAAGTGRWLRVWRPLMGVGARAGERRRGGHHGEQADHLHRRAARQLPGLHLLQ

SEQ ID NO: 751732 - protein, 175 aa, Homo sapiens
GQLPGQHLLQLKKDILKLHSRFYELAPNLVPMDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 751733 - protein, 192 aa, Homo sapiens
MGNKQTIFTEEQLDNYQDCTFFNKKDILKWGNRGSEGFGHSSRVTQAVHSLAPGPSCLSCTHSDCCVCFLQENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 751734 - protein, 206 aa, Homo sapiens
MGNKQTIFTEEQLDNYQDCTFFNKKDILKLHSRFYELAPNLVPMDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEGSCSCLCLWVMSTTLPASPTPWNPHWCAVHRFVNSW

SEQ ID NO: 751735 - protein, 187 aa, Homo sapiens
MGNKQTIFTEEQLDNYQDCTFFNKKDILKLHSRFYELAPNLVPMDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 751736 - protein, 144 aa, Homo sapiens; identical to SEQ ID NO: 751730

SEQ ID NO: 751737 - protein, 213 aa, Homo sapiens
MGNKQTIFTEEQLDNYQDCTFFNKKDILKLHSRFYELAPNLVPMDYRKSPIVHVPMSLIIQMPELRGSCPNANSGSVHVEESQDSAFRASSQENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 751738 - protein, 93 aa, Homo sapiens
PLGYPGPPGELRDGNYAFKIYDFNTDNFICKEDLELTLARLTKSELDEEEVVLVCDKVIEEADLDGDGKLGFADFEDMIAKAPDFLSTFHIRI

SEQ ID NO: 751739 - protein, 245 aa, Homo sapiens
PPVEKMAAVQVVGSWPSVQPREAPREAIPERGNGFRLLSARLCALRPDDSSSARTEIHLLFDQLISENYSEGSGVAPEDVSALLVQACRLVPLNQNHLVSKVSQLIHHLLNRLQVIVDEQHLDFLLAYTISAIHQCSSWTHREILQALAALVYCNGSKCQKYLPELLGNTGLLMKLSDLAQSDPEVRRAAVHCMANLCLSVPGQPYLEEPYQNVCFQAFLTILQSPKSSDMDDITFCMVSGLSLT

SEQ ID NO: 751740 - protein, 133 aa, Homo sapiens
PPVEKMAAVQVVGSWPSVQPREAPREAIPERGNGFRLLSARLCALRPDDSSSARTEIHLLFDQLISENYSEGSGVAPERQGLTLSSRLECSSKIIAHCDLKLLGSSHPPTSASQEAGTTYHHIQLIFLKKFFL

SEQ ID NO: 751741 - protein, 273 aa, Homo sapiens
PPVEKMAAVQVVGSWPSVQPREAPREAIPERGNGFRLLSARLCALRPDDSSSARTEIHLLFDQLISENYSEGSGVAPEDVSALLVQACRLVPLNQNHLVSKVSQLIHHLLNRLQYLPELLGNTGLLMKLSDLAQSDPEVRRAAVHCMANLCLSVPGQPYLEEPYQNVCFQAFLTILQSPKSSDMDDITFCMLLQNALKGIQSLLNGGRMKLTQTDELGALLAVLKKFMFHGLPGLNIEMPTVLYPTPLPQYDGRTPIKPQQSESSASRPTLNT

SEQ ID NO: 751742 - protein, 80 aa, Homo sapiens
AGWAGGAAAQGPRQRRGIGQSTGRQFGGSGERGPQAASGATSLGAFDVGAVGEGKGLACCLFSCSKIRCCEGAGRRTLCR

SEQ ID NO: 751743 - protein, 244 aa, Homo sapiens
MSAAAYMDFVAAQCLVSISNRAAVPEHGVAPDAERLRLPEREVTKEHGDPGDTWKDYCTLVTIAKSLLDLNKYRPIQTPSVCSDSLESPDEDMGSDSDVTTESGSSPSHSPEERQDPGSAPSPLSLLHPGVAAKGKHASEKRHKCPYSGCGKVYGKSSHLKAHYRVHTGERPFPCTWPDCLKKFSRSDELTRHYRTHTGEKQFRCPLCEKRFMRSDHLTKHARRHTEFHPSMIKRSKKALANAL

SEQ ID NO: 751744 - protein, 244 aa, Homo sapiens; identical to SEQ ID NO: 751743

SEQ ID NO: 751745 - protein, 244 aa, Homo sapiens; identical to SEQ ID NO: 751743

SEQ ID NO: 751746 - protein, 244 aa, Homo sapiens; identical to SEQ ID NO: 751743

SEQ ID NO: 751747 - protein, 244 aa, Homo sapiens; identical to SEQ ID NO: 751743

SEQ ID NO: 751748 - protein, 244 aa, Homo sapiens; identical to SEQ ID NO: 751743

SEQ ID NO: 751749 - protein, 244 aa, Homo sapiens; identical to SEQ ID NO: 751743

SEQ ID NO: 751750 - protein, 244 aa, Homo sapiens; identical to SEQ ID NO: 751743

SEQ ID NO: 751751 - protein, 244 aa, Homo sapiens; identical to SEQ ID NO: 751743

SEQ ID NO: 751752 - protein, 244 aa, Homo sapiens; identical to SEQ ID NO: 751743

SEQ ID NO: 751753 - protein, 101 aa, Homo sapiens
ARRAEAHSIFVLLTGPASLPAKDTGKGVPTSVPASLPCACVPGSHSHLACPRNQPADLISCPAPPPLALAFGVCAARPFLLSGCAGQGLSRRAAPTAGCLW

SEQ ID NO: 751754 - protein, 108 aa, Homo sapiens
PQPPTSRSGPGTPSPTTAQQVATLGAELEWSSKWLGRAKTPASLWDTTGTALQPLPAGVLLARTSKLSIHLAWAFAAPCRPGSSASTTLAPSQHAALPSSPVPLHCRK

SEQ ID NO: 751755 - protein, 84 aa, Homo sapiens
MTDNTAPRDSRQQSTLRVDQRNHGQRATRNARQRPAAPRDRARRDNQRRKRGTSRRTWERPGTEANSERRGATRTSEGRRHEAQ

SEQ ID NO: 751756 - protein, 74 aa, Homo sapiens
WSVRVLRRVGVFRPHCACRRAPGPRLSYFMAEEAKAQSGPVLRPGLCVGTGQSWAVNQGRLVSCCGVRLWETQE

SEQ ID NO: 751757 - protein, 148 aa, Homo sapiens
VGLRLRVLTSCSQLMLILMVQCMTMLLNVPLHFSTLPSGREWATPGTLHILAFVSCLSPLECKLQRNCIRSTWLRRPRASRHTRTGTRMGAQKFQDLTLERPGPGGCREVSITPASAESQERRLCHAQKPEMQLQGQREPERLTSHGR

SEQ ID NO: 751758 - protein, 73 aa, Homo sapiens
LWHIEALTNNTQKALNDSCMAISLLNNEDSRIRKTMLQNCMALDMLTAAQGGTFATIKTEFWIYILEESNDKT

SEQ ID NO: 751759 - protein, 72 aa, Homo sapiens
QKDSVHIHPDHQLHLRERAQSCPLGDGVTPLLASWEYSLGQNCNEAMPELKGVGLVGQRPSFIGTRNKSVSS

SEQ ID NO: 751760 - protein, 109 aa, Homo sapiens
EEGKAVASAPSAAHGDDAWHIRDPQAAAVASPAARAPAPAAVVTPPRLAVAPVPPAAPAARDMSNLGGRRNGPVEVRLTWTCHPHFRKTCIWFEKELKSRRYPTFTIYP

SEQ ID NO: 751761 - protein, 294 aa, Homo sapiens
KSLDKPEQFLYELSLIPNFSERVFCILFQSTFSESICSIRRKLELLQKLCETLKNGPGVMQVLGLVLAFGNYMNGGNKTRGQADGFGLDILPKLKDVKSSDNSRSLLSYIVSYYLRNFDEDAGKEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKAKISMKT

SEQ ID NO: 751762 - protein, 351 aa, Homo sapiens
MSSLHLDMKDIQHAVVNLDNSVVDLETLQALYENRAQSDELEKIEKHGRSSKDKENAKSLDKPEQFLYELSLIPNFSERVFCILFQSTFSESICSIRRKLELLQKLCETLKNGPGVMQVLGLVLAFGNYMNGGNKTRGQADGFGLDILPKLKDVKSSDNSRSLLSYIVSYYLRNFDEDAGKEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKAKISMKT

SEQ ID NO: 751763 - protein, 351 aa, Homo sapiens; identical to SEQ ID NO: 751762

SEQ ID NO: 751764 - protein, 779 aa, Homo sapiens
QGGHGGLPRAQRGRPLCGAGPWQPRPGLAANEEPSALENASGLSRGPAAAAMDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEVLGGRPGSPLPHCPSESPTCPHRESHTCAQRTESSSATGMALFTTSSTWPWPAPSAEGRDTGILDSTGWVPSPGASWCSLQETFLVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQADAGIAPPAGTCPVLTGCAGSAVRVRRGRSAGAALGKMVCARAALGPGALWAAAWGVLLLTAPAGAQRGRKKVVHVLEGESGSVVVQTAPGQVVSHRGGTIVLPCRYHYEAAAHGHDGVRLKWTKVVDPLAFTDVFVALGPQHRAFGSYRGRAELQGDGPGDASLVLRNVTLQDYGRYECEVTNELEDDAGMVKLDLEGVVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDATRRLFGVYCYRAPGAPDPAPGGWGWGWAGGGGWAGGARDPAAWTPLHV

SEQ ID NO: 751765 - protein, 526 aa, Homo sapiens
QGGHGGLPRAQRGRPLCGAGPWQPRPGLAANEEPSALENASGLSRGPAAAAMDIPPLAGKIAALSLSALPVSYALNHVSALSHPLWVALMSALILGLLFVAVYSLSHGEVSYDPLYAGRQLCGGLHGVLHQGGDLGDDQGAPYRTARLSLPPAPTGRAIPAHSARSLHLLLGWHCSLPPLPGHGRRHLQKVQEAGRGWPLTLGEKLHPQMGSQGRVEPEVSEEKSGRLSRAPARGGQEKVPGNVSGVGGGLALLTSTLCLGSHFCSWTEGLTVISPFNSLLSLPSWAKLKGTRSWETHGGLQALAGALRLRSDYLLVTPPSPAQEEIPEFWTLLAGFLRHEHPGVPYRKQFLVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQAQFSHMGASMHLRTPFTYRVPEDTWGCFFVCNLLYALGPHLLAYRCLQWPAFFHQPPPSDPLALHKKQH

SEQ ID NO: 751766 - protein, 914 aa, Homo sapiens
QGGHGGLPRAQRGRPLCGAGPWQPRPGLAANEEPSALENASGLSRGPAAAAMDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEVLGGRPGSPLPHCPSESPTCPHRESHTCAQRTESSSATGMALFTTSSTWPWPAPSAEGAGGRERVAPDPGREVASSDGVPGQGGARSVCRRNQDASLGLQPGVARRRFQGNVSGVGGGLALLTSTLCLGSHFCSWTEGLTVISPFNSLLSLPSWAKLKGTRSWETHGGLQALAGALRLRSDYLLVTPPSPAQEEIPEFWTLLAGFLRHEHPGVPYRKQFLVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQADAGIAPPAGTCPVLTGCAGSAVRVRRGRSAGAALGKMVCARAALGPGALWAAAWGVLLLTAPAGAQRGRKKVVHVLEGESGSVVVQTAPGQVVSHRGGTIVLPCRYHYEAAAHGHDGVRLKWTKVVDPLAFTDVFVALGPQHRAFGSYRGRAELQGDGPGDASLVLRNVTLQDYGRYECEVTNELEDDAGMVKLDLEGVVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDATRRLFGVYCYRAPGAPDPAPGGWGWGWAGGGGWAGGARDPAAWTPLHV

SEQ ID NO: 751767 - protein, 105 aa, Homo sapiens
MFYVLPFCGLAAYALTFPGCSWLPDWALVFAGGIGQAQFSHMGASMHLRTPFTYRVPEDTWGCFFVCNLLYALGPHLLAYRCLQWPAFFHQPPPSDPLALHKKQH

SEQ ID NO: 751768 - protein, 402 aa, Homo sapiens
QGGHGGLPRAQRGRPLCGAGPWQPRPGLAANEEPSALENASGLSRGPAAAAMDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEGEPYLRTAHGVFICYWDGTVHYLLYLAMAGAICRRKRYRNFGLYWLGSFAMSILVFLTGNILGKYSSEIRPAFFLTIPYLLVPCWAGMKVFSQPRALTRCTANMVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQAQFSHMGASMHLRTPFTYRCLQWPAFFHQPPPSDPLALHKKQH

SEQ ID NO: 751769 - protein, 105 aa, Homo sapiens; identical to SEQ ID NO: 751767

SEQ ID NO: 751770 - protein, 174 aa, Homo sapiens
MRLSPSHGPPTDSRIRKRFQLSATPGRQRLPLGGSDGNWLLRLQENSQLRGQEKASQGPAPSVRILNLHPECGPIKDWSDVTEMIQDQQGRRALRPSECGDSAASRPFPDLPQADAVTCVGLEAGIHRGSSAEKGESREGWLGGGGGGSVLKKKGKREEGKRRKKVKKRITFKI

SEQ ID NO: 751771 - protein, 464 aa, Homo sapiens
TAPDRPSCLVLRPGVGLVGRARARAMDSLFVEEVAASLVREFLSRKGLKKTCVTMDQERPRSDLSINNRNDLRKVLHLEFLYKENKAKENPLKTSLELITRYFLDHFGNTANNFTQDTPIPALSVPKKNNKVPSRCSETTLVNIYDLSDEDAGWRTSLSETSKARHDNLDGDVLGNFVSSKRPPHKSKPMQTVPGETPVLTSAWEKIDKLHSEPSLDVKRMGENSRPKSGLIVRGMMSGPIASSPQDSFHRHYLRRSSPSSSSTQPQEESRKVPELFVCTQQDILASSNSSPSRTSLGQLSELTVERQKTTASSPPHLPSKRLPPWDRARPRDPSEDTPAVDGSTDMDRMPLKLYLPGGNSRMTQERLERAFKRQGSQPAPVRKNQLLPSDKVDGELGALRLEDVEDELIREEVILSPVPSVLKLQTASKPIDLSVAKEIKTLLFGSSFCCFNEEWKLQSFSFS

SEQ ID NO: 751772 - protein, 782 aa, Homo sapiens
TAPDRPSCLVLRPGVGLVGRARARAMDSLFVEEVAASLVREFLSRKGLKKTCVTMDQERPRSDLSINNRNDLRKVLHLEFLYKENKAKENPLKTSLELITRYFLDHFGNTANNFTQDTPIPALSVPKKNNKVPSRCSETTLVNIYDLSDEDAGWRTSLSETSKARHDNLDGDVLGNFVSSKRPPHKSKPMQTVPGETPVLTSAWEKIDKLHSEPSLDVKRMGENSRPKSGLIVRGMMSGPIASSPQDSFHRHYLRRSSPSSSSTQPQEESRKVPELFVCTQQDILASSNSSPSRTSLGQLSELTVERQKTTASSPPHLPSKRLPPWDRARPRDPSEDTPAVDGSTDMDRMPLKLYLPGGNSRMTQERLERAFKRQGSQPAPVRKNQLLPSDKVDGELGALRLEDVEDELIREEVILSPVPSVLKLQTASKPIDLSVAKEIKTLLFGSSFCCFNEEWKLQSFSFSNTASLKYGIVQNKGGPCGVLAAVQGCVLQKLLFEGDSKADCAQGLQPSDAHRTRCLVLALADIVWRAGGRERAVVALASRTQQFSPTGKYKADGVLETLTLHSLTCYEDLVTFLQQSIHQFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTKWKGASVNWNGSDPIL

SEQ ID NO: 751773 - protein, 226 aa, Homo sapiens
PTGIQADESKKITLTVARYETCFLKPSSFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTKWKGASVNWNGSDPIL

SEQ ID NO: 751774 - protein, 226 aa, Homo sapiens
VARNGITWSHSQLKQNVEPPEPGKGSDLFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTKWKGASVNWNGSDPIL

SEQ ID NO: 751775 - protein, 705 aa, Homo sapiens
TAPDRPSCLVLRPGVGLVGRARARAMDSLFVEEVAASLVREFLSRKGLKKTCVTMDQERPRSDLSINNRNDLRKVLHLEFLYKENKAKENPLKTSLELITRYFLDHFGNTANNFTQDTPIPALSVPKKNNKVPSRCSETTLVNIYDLSDEDAGWRTSLSETSKARHDNLDGDVLGNFVSSKRPPHKSKPMQTVPGETPVLTSAWEKIDKLHSEPSLDVKRMGENSRPKSGLIVRGMMSGPIASSPQDSFHRHYLRRSSPSSSSTQPQEESRKVPELFVCTQQDILASSNSSPSRTSLGQLSELTVERQKTTASSPPHLPSKRLPPWDRARPRDPSEDTPAVDGSTDMDRMPLKLYLPGGNSRMTQERLERAFKRQGSQPAPVRKNQLLPSDKVDGELGALRLEDVEDELIREEVILSPVPSVLKLQTASKPIDLSVAKEIKTLLFGSSFCCFNEEWKLQSFSFSNTASLKYGIVQNKGGPCGVLAAVQGCVLQKLLFEGDSKADCAQGLQPSDAHRTRCLVLALADIVWRAGGRERAVVALASRTQQFSPTGKYKADGVLETLTLHSLTCYEDLVTFLQQSIHQFEVGPYGCILLTLSAILSRSTELIRQDFDVPTSHLIGAHGYCTQVRGRCGAQVVLPPPLSLREGEVLLPPLAPEKDKSFLPLPTLFKQLSRAHLCWVSLSCHGDPERELSLASVSGQLYVH

SEQ ID NO: 751776 - protein, 419 aa, Homo sapiens
MWWLITRKELALGVRTSETWKNQLLPSDKVDGELGALRLEDVEDELIREEVILSPVPSVLKLQTASKPIDLSVAKEIKTLLFGSSFCCFNEEWKLQSFSFSNTASLKYGIVQNKGGPCGVLAAVQGCVLQKLLFEGDSKADCAQGLQPSDAHRTRCLVLALADIVWRAGGRERAVVALASRTQQFSPTGKYKADGVLETLTLHSLTCYEDLVTFLQQSIHQFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTKWKGASVNWNGSDPIL

SEQ ID NO: 751777 - protein, 282 aa, Homo sapiens
PCLIHLPASRLSDISDSPMGCSPPLLGPHRMLEFWGLRPRAAVGHLNPDDSSGTGQPFTHIQLTLHSLTCYEDLVTFLQQSIHQFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTKWKGASVNWNGSDPIL

SEQ ID NO: 751778 - protein, 121 aa, Homo sapiens
FVRSDAESARYQIHYGAVSDWAPPVGRRNRGDYMAIQAYHSYTAYAVRSCDQTVWHLSISDSLSSLMLQEDAAFKVLSWKQRLCPHQMLNLLSTLIFHFTFIRTTAVIAPAILCRNDLKTD

SEQ ID NO: 751779 - protein, 115 aa, Homo sapiens
FVRSDAESARYQIHYGAVSDWAPPVGRRNRGDYMAIQAYHSYTAYAVRSCDQTVWHLSISDSLSSLMLQEDAAFKVLSWKQRLCPHQMLNLLSTLIFHFTFIRTTGAVAEMSHGR

SEQ ID NO: 751780 - protein, 117 aa, Homo sapiens
FVRSDAESARYQIHYGAVSDWAPPVGRRNRGDYMAIQAYHSYTAYAVRSCDQTVWHLSISDSLSSLMLQEDAAFKVLSWKQRLCPHQMLNLLSTLIFHFTFIRTGAKNSEFIEEINV

SEQ ID NO: 751781 - protein, 118 aa, Homo sapiens
FVRSDAESARYQIHYGAVSDWAPPVGRRNRGDYMAIQAYHSYTAYAVRSCDQTVWHLSISDSLSSLMLQEDAAFKVLSWKQRLCPHQMLNLLSTLIFHFTFIRTVLQRGHPLLKNRRT

SEQ ID NO: 751782 - protein, 118 aa, Homo sapiens
FVRSDAESARYQIHYGAVSDWAPPVGRRNRGDYMAIQAYHSYTAYAVRSCDQTVWHLSISDSLSSLMLQEDAAFKVLSWKQRLCPHQMLNLLSTLIFHFTFIRTRWSSTVLARMVLIS

SEQ ID NO: 751783 - protein, 383 aa, Homo sapiens
RHLPERDDLAKKLVSAELKLDDTERRIKELSKNLELSTNSFQRQLLAERKRAYEAHDENKVLQKEVQRLYHKLKEKERELDIKNIYSNRLPKSSPNKEKELALRKNAACQSDFADLCTKGVQTMEDFKPEEYPLTPETIMCYENKWEEPGHLTLDLQSQKQDRHGEAGILNPIMEREEKFVTDEELHVVKQEVEKLEDEWEREELDKKQKEKASLLEREEKPEWETGRYQLGMYPIQNMDKLQGEEEERLKREMLLAKLNEIDRELQDSRNLKYPVLPLLPDFESKLHSPERSPKTYRFSESSERLFNGHHLQDISFSTPKGEGQNSGNVRSPASPNEFAFGSYVPSFAKTSERSNPFSQKSSFLDFQRNSMEKLSKDGVDLI

SEQ ID NO: 751784 - protein, 148 aa, Homo sapiens
NPGLHAGGTTSLKRYQSSALTVCSEPSPQSDRASLARCPKTNHRGPIQLWQFLLELLHDGARSSCIRWTGNSREFQLCDPKEVARLWGERKRKPGMNYEKLSRGLRYYYRRDIVRKSGGRKYTYRFGGRVPSLAYPDCAGGGRGAETQ

SEQ ID NO: 751785 - protein, 48 aa, Homo sapiens
MTETSPAGVLRCYEHGSSCFRLSHGQSRAQSAPELAEWTDELSLKAQK

SEQ ID NO: 751786 - protein, 465 aa, Homo sapiens
LARSAGTVRGCAGAPARLPGGSVIMSLRQRLAQLVGRLQDPQKVARFQRLCGVEAPPRRSADRREDEKAEAPLAGDPRLRGRQPGAPGGPQPPGSDRNQCPAKPDGGGAPNGVRNGLAAELGPASPRRAGALRRNSLTGEEGQLARVSNWPLYCLFCFGTELGNELFYILFFPFWIWNLDPLVGRRLVVIWVLVMYLGQCTKDIIRWPRPASPPVVKLEVFYNSEYSMPSTHAMSGTAIPISMVLLTYGRWQYPLIYGLILIPCWCSLVCLSRIYMGMHSILDIIAGFLYTILILAVFYPFVDLIDNFNQTHKYAPFIIIGLHLALGIFSFTLDTWSTSRGDTAEILGSGAGIACGSHVTYNMGLVLDPSLDTLPLAGPPITVTLFGKAILRILIGMVFVLIIRDVMKKITIPLACKIFNIPCDDIRKARQHMEVELPYRYITYGMVGFSITFFVPYIFFFIGIS

SEQ ID NO: 751787 - protein, 465 aa, Homo sapiens; identical to SEQ ID NO: 751786

SEQ ID NO: 751788 - protein, 749 aa, Homo sapiens
LAAMAWIRSTCILFFTLLFAHIAAVPIKHLPEENVHDADFGEQKDISEINLAAGLDLFQGDILLQKSRNGLRDPNTRWTFPIPYILADNLGLNAKGAILYAFEMFRLKSCVDFKPYEGESSYIIFQQFDGCWSEVGDQHVGQNISIGQGCAYKAIIEHEILHALGFYHEQSRTDRDDYVNIWWDQILSGYQHNFDTYDDSLITDLNTPYDYESLMHYQPFSFNKNASVPTITAKIPEFNSIIGQRLDFSAIDLERLNRMYNCTTTHTLLDHCTFEKANICGMIQGTRDDTDWAHQDSAQAGEVDHTLLGQCTGAGYFMQFSTSSGSAEEAALLESRILYPKRKQQCLQFFYKMTGSPSDRLVVWVRRDDSTGNVRKLVKVQTFQGDDDHNWKIAHVVLKEEQKFRYLFQGTKGDPQNSTGGIYLDDITLTETPCPTGVWTVRNFSQVLENTSKGDKLQSPRFYNSEGYGFGVTLYPNSRESSGYLRLAFHVCSGENDAILEWPVENRQVIITILDQEPDVRNRMSSSMVFTTSKSHTSPAINDTVIWDRPSRVGTYHTDCNCFRSIDLGWSGFISHQMLKRRSFLKNDDLIIFVDFEDITHLSQTEVPTKGKRLSPQGLILQGQEQQVSEEGSGKAMLEEALPVSLSQGQPSRQKRSVENTGPLEDHNWPQYFRDPCDPNPCQNDGICVNVKGMASCRCISGHAFFYTGERCQAVQVHGSVLGMVIGGTAGVIFLTFSIIAILSQRPRK

SEQ ID NO: 751789 - protein, 605 aa, Homo sapiens
MGRLLRAARLPPLLSPLLLLLVGGAFLGACVAGSDEPGPEGLTSTSLLDLLLPTGLEPLDSEEPSETMGLGAGLGAPGSGFPSEENEESRILQPPQYFWEEEEELNDSSLDLGPTADYVFPDLTEKAGSIEDTSQAQELPNLPSPLPKMNLVEPPWHMPPREEEEEEEEEEEREKEEVEKQEEEEEEELLPVNGSQEEAKPQVRDFSLTSSSQTPGATKSRHEDSGDQASSGVEVESSMGPSLLLPSVTPTTVTPGDQDSTSQEAEATVLPAAGLGVEFEAPQEASEEATAGAAGLSGQHEEVPALPSFPQTTAPSGAEHPDEDPLGSRTSASSPLAPGDMELTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 751790 - protein, 563 aa, Homo sapiens
MGRLLRAARLPPLLSPLLLLLVGGAFLGACVAGSDEPGPEGLTSTSLLDLLLPTGLEPLDSEEPSETMGLGAGLGAPGSGFPSEENEESRILQPPQYFWEEEEELNDSSLDLGPTADYVFPDLTEKAGSIEDTSQAQELPNLPSPLPKMNLVEPPWHMPPREEEEEEEEEEEREKEEVEKQEEEEEEELLPVNGSQEEAKPQVRDFSLTSSSQTPGATKSRHEDSGDQASSGVEVESSMGPSLLLPSVTPTTVTPGDQDSTSQEAEATVLPAAGLGVEFEAPQEASEEATAGAAGLSGQHEEVPALPSFPQTTAPSGAEHPDEDPLGSRTSASSPLAPGDMELTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGTLFVVLVVIGAICIIIIALGLLYNCWQRRLPKLKHVVSVGTGGAGGQLRGECPSIGVLICKGRQ

SEQ ID NO: 751791 - protein, 353 aa, Homo sapiens
GRVGMLLSTSTPDEATVLPAAGLGVEFEAPQEASEEATAGAAGLSGQHEEVPALPSFPQTTAPSGAEHPDEDPLGSRTSASSPLAPGDMELTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 751792 - protein, 313 aa, Homo sapiens
MGYATGEHEEVPALPSFPQTTAPSGAEHPDEDPLGSRTSASSPLAPGDMELTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 751793 - protein, 387 aa, Homo sapiens
MGRLLRAARLPPLLSPLLLLLVGGAFLGACVAGSDEPGPEGLTSTSLLDLLLPTGLEPLDSEEPSETMGLGAGLGAPGSGFPSEENEESRILQPPQYFWEEEEELNDSSLDLGPTAGALLTYRALTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 751794 - protein, 158 aa, Homo sapiens
MTLVGEQGVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 751795 - protein, 184 aa, Homo sapiens
MASKRALVILAKGAEEMETVIPVGLHPTPQAPLRVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 751796 - protein, 141 aa, Homo sapiens [sequence omitted]

SEQ ID NO: 751797 - protein, 245 aa, Homo sapiens
MISTRVMDIKLREAAEGLGEDSTGKKKSKFKTFKKFFGKKKRKESPSSTGSSTWKQSQTRNEVIAIESGPVGYDSEDELEESRGTLGSRALSHDSIFIPESGQDATRPVRVFSQENVCDRIKALQLKIQCNVKMGPPPPPGGLPAKRGEDAGMSSEDDGLPRSPPEMSLLHDVGPGTTIKVSVVSPDHVSDSTVSARISDNSLAPVADFSYPAESSSCLDNSAAKHKLQVKPRNQRSSKMRRLSS

SEQ ID NO: 751798 - protein, 112 aa, Homo sapiens
MGPPPPPGGLPAKRGEDAGMSSEDDGLPRSPPEMSLLHDVGPGTTIKVSVVSPDHVSDSTVSARISDNSLAPVADFSYPAESSSCLDNSAAKHKLQVKPRNQRSSKMRRLSS

SEQ ID NO: 751799 - protein, 133 aa, Homo sapiens
GELSGVRPRRAERSASEAGAPAAGSWELGARRAQGRAGRGRVVSAPASSSSAADPGCLEAARPPAASPRLWAGARRAPRREQPRLAAPRGRCPSLRVSPSPGHAPVPGFNSMIVCYEYMAACLKKFTGFKMWA

SEQ ID NO: 751800 - protein, 259 aa, Homo sapiens
MISLASVQDKSELDMISTRVMDIKLREAAEGLGEDSTGKKKSKFKTFKKFFGKKKRKESPSSTGSSTWKQSQTRNEVIAIESGPVGYDSEDELEESRGTLGSRALSHDSIFIPESGQDATRPVRVFSQENVCDRIKALQLKIQCNVKMGPPPPPGGLPAKRGEDAGMSSEDDGLPRSPPEMSLLHDVGPGTTIKVSVVSPDHVSDSTVSARISDNSLAPVADFSYPAESSSCLDNSAAKHKLQVKPRNQRSSKMRRLSS

SEQ ID NO: 751801 - protein, 41 aa, Homo sapiens
MGPPPPPGGLPAKRGEDAGMSSEDDGLPRSPPEMSLLHDVG

SEQ ID NO: 751802 - protein, 184 aa, Homo sapiens
CKHIVFVQLQEGEHVFQPREPDPSICVVQDGRLEVCIQDTDGTEVVVKEVLAGDSVHSLLSILDIITGHAAPYKTVSVRAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSGTVLH

SEQ ID NO: 751803 - protein, 152 aa, Homo sapiens
MFHENLVRVVERLAGASPSSYRCPDRGPEVSGLSSTWKPLTSVAIKPPDKTSPEAFWLHQKTDGRPVFTDAYTSSWLPPTEVASVQKFIPEHQAGGCQLLLRFRCIRKLMHLVQMSRSGSDSPGLGSGDTDDSLEQSGFSRNGRDKSQARGV

SEQ ID NO: 751804 - protein, 189 aa, Homo sapiens
GLPFPCFPPEPFLLFPPLAQGNPQATRRRGPIQEGIVPLEEPLVRVVERLAGASPSSYRCPDRGPEVSGLSSTWKPLTSVAIKPPDKTSPEAFWLHQKTDGRPVFTDAYTSSWLPPTEVASVQKFIPEHQAGGCQLLLRFRCIRKLMHLVQMSRSGSDSPGLGSGDTDDSLEQSGFSRNGRDKSQARGV

SEQ ID NO: 751805 - protein, 362 aa, Homo sapiens
SRAPAGVTPAIVPTSTWAARQAGDGGPGAMGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWANLTTEERLASSRPPLFLDPPPQNGQKPPSRPSSSASKKQYV

SEQ ID NO: 751806 - protein, 362 aa, Homo sapiens; identical to SEQ ID NO: 751805

SEQ ID NO: 751807 - protein, 333 aa, Homo sapiens
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWANLTTEERLASSRPPLFLDPPPQNGQKPPSRPSSSASKKQYV

SEQ ID NO: 751808 - protein, 162 aa, Homo sapiens
NIIIKKSKDHCTPAWATRAKLPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWANLTTEERLASSRPPLFLDPPPQNGQKPPSRPSSSASKKQYV

SEQ ID NO: 751809 - protein, 1932 aa, Homo sapiens
SFKSVWWLRRRLRAWGPGRGARPWGRASGAAVGLGGASTWPEGGHPEPAEGQACPQARLPAMPSVCLLLLLFLAVGGALGNRPFRAFVVTDTTLTHLAVHRVTGEVFVGAVNRVFKLAPNLTELRAHVTGPVEDNARCYPPPSMRVCAHRLAPVDNINKLLLIDYAARRLVACGSIWQGICQFLRLDDLFKLGEPHHRKEHYLSGAQEPDSMAGVIVEQGQGPSKLFVGTAVDGKSEYFPTLSSRKLISDEDSADMFSLVYQDEFVSSQIKIPSDTLSLYPAFDIYYIYGFVSASFVYFLTLQLDTQQTLLDTAGEKFFTSKIVRMCAGDSEFYSYVEFPIGCSWRGVEYRLVQSAHLAKPGLLLAQALGVPADEDVLFTIFSQGQKNRASPPRQTILCLFTLSNINAHIRRRIQSCYRGEGTLALPWLLNKELPCINTPMQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGENLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751810 - protein, 1542 aa, Homo sapiens
MQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEVRRAPHVRGWALWCGRGHRLLCVLGFFEPSPGWAWRRVALCAADRCFPQQGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGENLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751811 - protein, 1147 aa, Homo sapiens
TQAHFSQSHTGGDFCCFNRVLLCHPGSQKCAWVRTQAHFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGENLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751812 - protein, 814 aa, Homo sapiens
GQYGCGWKIKTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751813 - protein, 505 aa, Homo sapiens
TLVLPVDLRIPAEMTVAKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751814 - protein, 457 aa, Homo sapiens
MLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751815 - protein, 1413 aa, Homo sapiens
MQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEVRRAPHVRGWALWCGRGHRLLCVLGFFEPSPGWAWRRVALCAADRCFPQQGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGENLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNWYHPVLGCQQPVWRLVGGRRWWLC

SEQ ID NO: 751816 - protein, 749 aa, Homo sapiens
MQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEVRRAPHVRGWALWCGRGHRLLCVLGFFEPSPGWAWRRVALCAADRCFPQQGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGENLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNVSTSCPAPPRP

SEQ ID NO: 751817 - protein, 974 aa, Homo sapiens
MEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751818 - protein, 1066 aa, Homo sapiens
MQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751819 - protein, 615 aa, Homo sapiens
TLADLSTCSRVGLEYKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751820 - protein, 176 aa, Homo sapiens
MCTWEGPLGANQGASGARPSVVHSLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 751821 - protein, 829 aa, Homo sapiens
MQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEVRRAPHVRGWALWCGRGHRLLCVLGFFEPSPGWAWRRVALCAADRCFPQQGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGENLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRPSSARPVGPRRPCLTTLCLLPPLRNLALSDSPRPPVLSSLVA

SEQ ID NO: 751822 - protein, 106 aa, Homo sapiens
MSPERHTQGPNRYYRDIAKMASISDQDMDAYLVEQSRLHASDFSVLSALNELYFYVTKYRQEVCVIPTDSQLLGPEGAASDKGRRVGGGWGLFTVSPLTRAWGRHR

SEQ ID NO: 751823 - protein, 66 aa, Homo sapiens
PGSRPLRSGTNAWQPGAQGEELPVAQDPGASQAPRAPRVDRKPPEHRGVGGLGQSMGPSCSCDLFS

SEQ ID NO: 751824 - protein, 596 aa, Homo sapiens
MNRTWPRRIWGSSQDEAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 751825 - protein, 548 aa, Homo sapiens
MGRKAIVLAIANTSLAFPLCQHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEDKEKVSELEAVMEKQKKKVEGEVEMEVI

SEQ ID NO: 751826 - protein, 443 aa, Homo sapiens
KKKKKKKKNRGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 751827 - protein, 326 aa, Homo sapiens
EQIEGRLEGSNVGGDENKAVRLEETKGGLGEGPSRGSQQGQRAGSCRPHTGGAAALKTPPLLLHSHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 751828 - protein, 277 aa, Homo sapiens [sequence omitted]

SEQ ID NO: 751829 - protein, 132 aa, Homo sapiens
HQGKSRPQVKSDRGRAGCADRGAAFLAAEGGAAGGEPRGGGTCVQPGHRAALAAGGQRESVRAGGSDGEAKEEGGRRGGNGGHLTCQAPFAKSDEAPWENGLLRLSPIAEVDLLKDGQSAPALVFPHPGGQT

SEQ ID NO: 751830 - protein, 299 aa, Homo sapiens
KKKKKKKKNRGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPARCSSLTMSIWENFSFSLG

SEQ ID NO: 751831 - protein, 182 aa, Homo sapiens
KKKKKKKKNRGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNG

SEQ ID NO: 751832 - protein, 506 aa, Homo sapiens
DLFQMSPLSPGSPLPPLARADLTAILTGCPPLSACLVLAPRPHRRARLLPSEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 751833 - protein, 443 aa, Homo sapiens; identical to SEQ ID NO: 751826

SEQ ID NO: 751834 - protein, 443 aa, Homo sapiens; identical to SEQ ID NO: 751826

SEQ ID NO: 751835 - protein, 126 aa, Homo sapiens [sequence omitted]

SEQ ID NO: 751836 - protein, 443 aa, Homo sapiens
KKKKKKKKNRGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVDIPAG

SEQ ID NO: 751837 - protein, 145 aa, Homo sapiens
KKKKKKKKNRGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSHGGGTPTREHPPTERA

SEQ ID NO: 751838 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 751839 - protein, 250 aa, Homo sapiens; identical to SEQ ID NO: 751838

SEQ ID NO: 751840 - protein, 282 aa, Homo sapiens
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 751841 - protein, 250 aa, Homo sapiens; identical to SEQ ID NO: 751838

SEQ ID NO: 751842 - protein, 75 aa, Homo sapiens
RILNAMTEKGWKNEMTTVMNISGLLPLCGRLPVTSEVHPRTPTCENWTHGDAQNPKTLLTVQQASSRVPLAFSRG

SEQ ID NO: 751843 - protein, 805 aa, Homo sapiens
TLRRLSPRPQHPELFSGQACACSPSLPPGAAATHPQMVGPEDAGACSGRNPKLLPVPAPDPVGQDRKVIRATGGFGGGVGAVEPPEEADEEEETPPRQLLQRYLAAAGEQLEPGLCYCPLPAGQAGAPPPSAAPRSDACLLGSGSKHRGAEVADGRAPRHEGMTNGDSGFLPGRDCRDLEEARGLARAGGRESRRRRPYGRLRLEGPGDEDADGAGSPSDWASPLEDPLRSCCLVAADAQEPEGAGSDSGDSPASSCSSSEDSEQRGVGAGGPEEGAPPATSAERTNGGAEPRLGFSDIHFNSRNTFQVSRGQSARDHLPPAGPPVPLPAAEQGPAGASARARRSGGFADFFTRNLFPKRTKELKSVVHSAPGWKLFGKVPPRENLQKTSKIIQQEYEARTGRTCKPPPQSSRRKNFEFEPLSTTALILEDRPSNLPAKSVEEALRHRQEYDEMVAEAKKREIKEAHKRKRIMKERFKQEENIASAMVIWINEILPNWEVMRSTRRVRELWWQGLPPSVRGKVWSLAVGNELNITPELYEIFLSRAKERWKSFSETSSENDTEGVSVADREASLELIKLDISRTFPSLYIFQKGGPYHDVLHSILGAYTCYRPDVGYVQGMSFIAAVLILNLEEADAFIAFANLLNKPCQLAFFRVDHSMMLKYFATFEVFFEENLSKLFLHFKSYSLTPDIYLIDWIFTLYSKSLPLDLACRVWDVFCRDGEEFLFRTGLGILRLYEDILLQMDFIHIAQFLTKLPEDITSEKLFSCIAAIQMQNSTKKWTQVFASVMKDIKEGDKNSSPALKS

SEQ ID NO: 751844 - protein, 805 aa, Homo sapiens; identical to SEQ ID NO: 751843

SEQ ID NO: 751845 - protein, 690 aa, Homo sapiens
TLRRLSPRPQHPELFSGQACACSPSLPPGAAATHPQMVGPEDAGACSGRNPKLLPVPAPDPVGQDRKVIRATGGFGGGVGAVEPPEEADEEEEADEEEETPPRQLLQRYLAAAGEQLEPGLCYCPLPAGQAGAPPPSAAPRSDACLLGSGSKHRGAEVADGRAPRHEGMTNGDSGFLPGRDCRDLEEARGLARAGGRESRRRRPYGRLRLEGPGDEDADGAGSPSDWASPLEDPLRSCCLVAADAQEPEGAGSDSGDSPASSCSSSEDSEQRGVGAGGPEEGAPPATSAERTNGGAEPRLGFSDIHFNSRNTFQVSRGQSARDHLPPAGPPVPLPAAEQGPAGASARARRSGGFADFFTRNLFPKRTKELKSVVHSAPGWKLFGKVPPRENLQKTSKIIQQEYEARTGRTCKPPPQSSRRKNFEFEPLSTTALILEDRPSNLPAKSVEEALRHRQEYDEMVAEAKKREIKEAHKRKRIMKERFKQEENIASAMVIWINEILPNWEVMRSTRRVRELWWQGLPPSVRGKVWSLAVGNELNITPELYEIFLSRAKERWKSFSETSSENDTEGVSVADREASLELIKLDISRTFPSLYIFQKGGPYHDVLHSILGAYTCYRPDVGYVQGMSFIAAVLILNLEEADAFIAFANLLNKPCQLAFFRVDHSMMLKYFATFEVFFEENLSKLDLHTI

SEQ ID NO: 751846 - protein, 811 aa, Homo sapiens
TLRRLSPRPQHPELFSGQACACSPSLPPGAAATHPQMVGPEDAGACSGRNPKLLPVPAPDPVGQDRKVIRATGGFGGGVGAVEPPEEADEEEEADEEEETPPRQLLQRYLAAAGEQLEPGLCYCPLPAGQAGAPPPSAAPRSDACLLGSGSKHRGAEVADGRAPRHEGMTNGDSGFLPGRDCRDLEEARGLARAGGRESRRRRPYGRLRLEGPGDEDADGAGSPSDWASPLEDPLRSCCLVAADAQEPEGAGSDSGDSPASSCSSSEDSEQRGVGAGGPEEGAPPATSAERTNGGAEPRLGFSDIHFNSRNTFQVSRGQSARDHLPPAGPPVPLPAAEQGPAGASARARRSGGFADFFTRNLFPKRTKELKSVVHSAPGWKLFGKVPPRENLQKTSKIIQQEYEARTGRTCKPPPQSSRRKNFEFEPLSTTALILEDRPSNLPAKSVEEALRHRQEYDEMVAEAKKREIKEAHKRKRIMKERFKQEENIASAMVIWINEILPNWEVMRSTRRVRELWWQGLPPSVRGKVWSLAVGNELNITPELYEIFLSRAKERWKSFSETSSENDTEGVSVADREASLELIKLDISRTFPSLYIFQKGGPYHDVLHSILGAYTCYRPDVGYVQGMSFIAAVLILNLEEADAFIAFANLLNKPCQLAFFRVDHSMMLKYFATFEVFFEENLSKLFLHFKSYSLTPDIYLIDWIFTLYSKSLPLDLACRVWDVFCRDGEEFLFRTGLGILRLYEDILLQMDFIHIAQFLTKLPEDITSEKLFSCIAAIQMQNSTKKWTQVFASVMKDIKEGDKNSSPALKS

SEQ ID NO: 751847 - protein, 79 aa, Homo sapiens
CKPRTFESSRRKNFEFEPLSTTALILEDRPSNLFPKRTKELKSVVHSAPGWKLFGKVPPRENLQKTSKIIQQVSTDIAM

SEQ ID NO: 751848 - protein, 805 aa, Homo sapiens; identical to SEQ ID NO: 751843

SEQ ID NO: 751849 - protein, 805 aa, Homo sapiens; identical to SEQ ID NO: 751843

SEQ ID NO: 751850 - protein, 112 aa, Homo sapiens [sequence omitted]

SEQ ID NO: 751851 - protein, 319 aa, Homo sapiens
MAICPELAQTDKSALANLSDETETLKNFTDEVQTSSSFSSSGGRQSSPLTSGSKLEREKQTPSLEQGDTQSELLDYKNYEKKLSKKWINYLKLKDSNFERHQPDTKLPTEITRVSDEELNALQSYCTMKINLIHRRGDSKKKTSSRHKKLHLGLDVEASERDAFSCTVPDELLNRIYFKNMRTTPKQEAAAKQHISYQCPYCNRKRAELALSAFLKQKKTLLESFLLQERIDEHLHTKDFLTRIGEAHQDFPRLSDDPRIIWKRLTEKSHIRYSGFERSETEQKMQRDGNSACHLPFSLPFLKRLTLIKPELVIVNDNV

SEQ ID NO: 751852 - protein, 79 aa, Homo sapiens
SITVGIRRKQSSGFARDLRCIHSESRGPIMFHVSLDLAQILLSPSAACSLKILQHITVSNMIISVFTHFRRRDQGGDQT

SEQ ID NO: 751853 - protein, 223 aa, Homo sapiens
RGSPGSRCRCDIQMTQIPPSLAASVGERTMTCRASEGIGAFLGWYQKKPGAAPRLLVYGATNLQSGVPSRFSGRGVGSDVSLTIEKSPALKTSLVYICPVLFFPFSYGPGTTLDHKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFYRGEC

SEQ ID NO: 751854 - protein, 167 aa, Homo sapiens
MRIRNVTCRVESLMFAGSRSGTHFTLTIAVFKLKDSGLYFLSQGYAAPFTFGPGTTVSVNRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFYRGEC

SEQ ID NO: 751855 - protein, 202 aa, Homo sapiens
RCSFVSGKSTSLQVSQSLTAILGWYSIIWQAPGSSSIDATRRAICIPDRFSGSGSGTDFTFTISSLQPEDFATYYCQQYDDLVFTFGPGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFYRGEC

SEQ ID NO: 751856 - protein, 230 aa, Homo sapiens
LGPHLQSKGTQRTHMGTFVDKRFCLRQLPLHQESVSVYRVSRPQSQRPQGRGKAHAGSVSRGGIRNPASTLETAWHLFGFGRKPVGIDEPIGLVQGSSVTSRAASAVLWSKAGQALGTPAGDKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFYRGEC

SEQ ID NO: 751857 - protein, 84 aa, Homo sapiens
PGITAPVQQEKRLPSCPKPAFSVVPQLLGQVEPPLKLVSTCPRLPTAAHSSAFRAEPRAQRMEKPESGEVRERASRHTTEVIGL

SEQ ID NO: 751858 - protein, 216 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKPYPWYVRHLHPVPSAHAFIASHSTTVHCLRTCAWTTKLPNLVCHTVNIILPRRNKQECYLAAWCSRTEHSWAIMNIAVRQGTLQLGSYHVADTIEVETR

SEQ ID NO: 751859 - protein, 255 aa, Homo sapiens
MAEPSAATQSHSISSSSFGAEPSAPGGGGSPGACPALGTKSCSSSCADSFVSSSSSQPVSLFSTSQVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 751860 - protein, 194 aa, Homo sapiens
AVTLADPFVYCGRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 751861 - protein, 236 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 751862 - protein, 117 aa, Homo sapiens
MAEPSAATQSHSISSSSFGAEPSAPGGGGSPGACPALGTKSCSSSCAADLGNSSDYKCHTDQLEESLLIGAVLKGLLVYGLHSIYCVHAFINFLLPANFSHVSWYRSAVSKLCKGFS

SEQ ID NO: 751863 - protein, 76 aa, Homo sapiens
FCQRNIKGQSKQRTRGIREKKRRMEREVCPEGKRRARLKSDSGLRTGRVPEFDHCQNPVFQDGVGEASKILDPGPQ

SEQ ID NO: 751864 - protein, 119 aa, Homo sapiens
MGARSFCPIVGSTLLLPNHWAHAPSARSLGSRSFCPILGARSFCPIVGRTLLLPDRWAHAPSARSLGARSFCPIVGSTLLLPDRWAHAPSARSLGARFFCLIVGRTLLLPDRWAHAPSA

SEQ ID NO: 751865 - protein, 95 aa, Homo sapiens
MHEEMAQNGDSRDKPPPKRVAHSRTICDTVFPNGGGLGTRADAQDRGSDQHCSAAIGPWAAPALISSSAGWGEPGHFTQGTVRGRLCDHARSLGK

SEQ ID NO: 751866 - protein, 147 aa, Homo sapiens
MHEEMAQNGDSRDKPPPKRVAHSRTICDTVFPNGGGLGTRADAQDRGSDQHCSAAIGPLFPSPVTGKKGGGEGTREGKSAPLRRKHQRVEGRFPHPLALEAEELREEQGVEPGGGFMSAQQLEQTRWCGGKGSGALSQSLFPSGDPL

SEQ ID NO: 751867 - protein, 75 aa, Homo sapiens
EELASAEVNNLARRFWWPGIPVLARGAASQRRTDPCRARIGSRDPGGSAASVLSSRRESESRATREWRWRARRSL

SEQ ID NO: 751868 - protein, 41 aa, Homo sapiens
MTDRTLGALAPSNKWWSHVSRAVVTSFLVTPLDMVEGPFAA

SEQ ID NO: 751869 - protein, 334 aa, Homo sapiens
MAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 751870 - protein, 334 aa, Homo sapiens; identical to SEQ ID NO: 751869

SEQ ID NO: 751871 - protein, 335 aa, Homo sapiens
MAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHLC

SEQ ID NO: 751872 - protein, 330 aa, Homo sapiens
MADIIARLREDGIQKRVIQEGRGELPDFQDGTKATFHYRTLHSDDEGTVLDDSRARGKPMELIIGKKFKLPVWETIVCTMREGEIAQFLCDIKHVVLYPLVAKSLRNIAVGKDPLEGQRHCCGVAQMREHSSLGHADLDALQQNPQPLIFHMEMLKVESPGTYQQDPWAMTDEEKAKAVPLIHQEGNRLYREGHVKEAAAKYYDAIACLKNLQMKEQPGSPEWIQLDKQITPLLLNYCQCKLVVEEYYEVLDHCSSILNKYDDNVKAYFKRGKAHAAVWNAQEAQADFAKVLELDPALAPVVSRELRALEARIRQKDEEDKARFRGIFSH

SEQ ID NO: 751873 - protein, 169 aa, Homo sapiens
MELIIGKKFKLPVWETIVCTMREGEIAQFLCDIKHVVLYPLVAKSLRNIAVGKDPLEGQRHCCGVAQMREHSSLGHADLDALQQNPQPLIFHMEMLKVESPGTYQQDPWAMTDEEKAKAVPLIHQEGNRLYREGHVKEAAAKYYDAIACLKNLQMKSPVGSSKQQYRCL

SEQ ID NO: 751874 - protein, 330 aa, Homo sapiens; identical to SEQ ID NO: 751872

SEQ ID NO: 751875 - protein, 330 aa, Homo sapiens; identical to SEQ ID NO: 751872

SEQ ID NO: 751876 - protein, 330 aa, Homo sapiens; identical to SEQ ID NO: 751872

SEQ ID NO: 751877 - protein, 260 aa, Homo sapiens
MADIIARLREDGIQKRVIQEGRGELPDFQDGTKATFHYRTLHSDDEGTVLDDSRARGKPMELIIGKKFKLPVWETIVCTMREGEIAQFLCDIKHVVLYPLVAKSLRNIAVGKDPLEGQRHCCGVAQMREHSSLGHADLDALQQNPQPLIFHMEMLKVESPGTYQQDPWAMTDEEKAKAVPLIHQEGNRLYREGHVKEAAAKYYDAIACLKNLQMKADFAKVLELDPALAPVVSRELRALEARIRQKDEEDKARFRGIFSH

SEQ ID NO: 751878 - protein, 228 aa, Homo sapiens
MADIIARLREDGIQKRVIQEGRGELPDFQDGTKATFHYRTLHSDDEGTVLDDSRARGKPMELIIGKKFKLPVWETIVCTMREGEIAQFLCDIKHVVLYPLVAKSLRNIAVGKDPLEGQRHCCGVAQMREHSSLGHADLDALQQNPQPLIFHMEMLKVESPGTYQQDPWAMTDEEKAKAVPLIHQEGNRLYREGHVKEAAAKYYDAIACLKNLQMKSPVGSSKQQYRCL

SEQ ID NO: 751879 - protein, 199 aa, Homo sapiens
VVNSSSWSMVQQNPQPLIFHMEMLKVESPGTYQQDPWAMTDEEKAKAVPLIHQEGNRLYREGHVKEAAAKYYDAIACLKNLQMKEQPGSPEWIQLDKQITPLLLNYCQCKLVVEEYYEVLDHCSSILNKYDDNVKAYFKRGKAHAAVWNAQEAQADFAKVLELDPALAPVVSRELRALEARIRQKDEEDKARFRGIFSH

SEQ ID NO: 751880 - protein, 208 aa, Homo sapiens
MADIIARLREDGIQKRVIQEGRGELPDFQDGTKATFHYRTLHSDDEGTVLDDSRARGKPMELIIGKKFKLPVWETIVCTMREGEIAQFLCDIKHVVLYPLVAKSLRNIAVGKDPLEGQRHCCGVAQMREHSSLGHADLDAHNVKAYFKRGKAHAAVWNAQEAQADFAKVLELDPALAPVVSRELRALEARIRQKDEEDKARFRGIFSH

SEQ ID NO: 751881 - protein, 102 aa, Homo sapiens
MWVRSAADGRSCGVPEPRCDMPHALPGGEPWHVPAGPMGHDRRREGKGAVWNAQEAQADFAKVLELDPALAPVVSRELRALEARIRQKDEEDKARFRGIFSH

SEQ ID NO: 751882 - protein, 330 aa, Homo sapiens; identical to SEQ ID NO: 751872

SEQ ID NO: 751883 - protein, 330 aa, Homo sapiens; identical to SEQ ID NO: 751872

SEQ ID NO: 751884 - protein, 330 aa, Homo sapiens; identical to SEQ ID NO: 751872

SEQ ID NO: 751885 - protein, 267 aa, Homo sapiens [sequence omitted]

SEQ ID NO: 751886 - protein, 125 aa, Homo sapiens
MGPRPRSTTGRCTVTTRAPCWTTAGLVASPWSSSLARSSSCLCGRPSCAPCEKGRLPSSSVTSSMWSCTRWWPRVSATSRWARTPWRASGTAAVLHRCVNTAPWAMLTWTPCSRTPSPSSSTWRC

SEQ ID NO: 751887 - protein, 156 aa, Homo sapiens
MADIIARLREDGIQKRVIQEGRGELPDFQDGTKATFHYRTLHSDDEGTVLDDSRARGKPMELIIGKKFKLPVWETIVCTMREGEIAQFLCDIKHVVLYPLVAKSLRNIAVGKDPLEGQRHCCGVAQMREHSSLGHADLDALAPELQLAPELAAARP

SEQ ID NO: 751888 - protein, 342 aa, Homo sapiens
QSPATGGRLRGAPEAAGAMAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGG

SEQ ID NO: 751889 - protein, 356 aa, Homo sapiens
QSPATGGRLRGAPEAAGAMAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGVSQEERQGSPAGGSG

SEQ ID NO: 751890 - protein, 356 aa, Homo sapiens; identical to SEQ ID NO: 751889

SEQ ID NO: 751891 - protein, 323 aa, Homo sapiens
KAQLQAGDCGGPLRRRGPWLGSRAWEKLPTQMNGATAAWAPWVRTQRPPEDLGWARSWARGCRGLPSSSATSLRMGTRFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGG

SEQ ID NO: 751892 - protein, 277 aa, Homo sapiens
DALSYNTQSAPVRALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGG

SEQ ID NO: 751893 - protein, 266 aa, Homo sapiens
MWALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGG

SEQ ID NO: 751894 - protein, 238 aa, Homo sapiens
MDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGG

SEQ ID NO: 751895 - protein, 338 aa, Homo sapiens
QSPATGGRLRGAPEAAGAMAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDMTAA

SEQ ID NO: 751896 - protein, 78 aa, Homo sapiens
QSPATGGRLRGAPEAAGAMAGVACLGKAADADEWCDSGLGSLGPDAAAPGGPGLGAELGPGLSWAPLVFGYVTEDGDT

SEQ ID NO: 751897 - protein, 117 aa, Homo sapiens
RRLRQENHLNLGGGGCSEPDRAMHSSLGNRERLRLKKKRRRKKRKYSNICNCIEHLQGRNHARYIFVCPADSVALYLFANILLCCLLYAKHVTSTPNILTNVHSKTLGKNVIFKSIQ

SEQ ID NO: 751898 - protein, 122 aa, Homo sapiens
STVPAAWEAWPRGPGGHSCLVESEGSLTENIWAFAGISRPCALALLRRDVLGAFLLWPELGASGQWCLSVRTQCGVVPHQVFRNHLGRYCLEHLPAEFPSLEALVENHAVTERSLFCPLDMG

SEQ ID NO: 751899 - protein, 783 aa, Homo sapiens
MRWQCGTRFRGLRPAVAPWTALLALGLPGWVLAVSATAAAVVPEQHASVAGQHPLDWLLTDRGPFHRAQEYADFMERYRQGFTTRYRIYREFARWKVNNLALERKDFFSLPLPLAPEFIRNIRLLGRRPNLQQVTENLIKKYGTHFLLSATLGGEESLTIFVDKQKLGRKTETTGGASIIGGSGNSTAVSLETLHQLAASYFIDRESTLRRLHHIQIATGAIKVTETRTGPLGCSNYDNLDSVSSVLVQSPENKVQLLGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKERSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 751900 - protein, 783 aa, Homo sapiens; identical to SEQ ID NO: 751899

SEQ ID NO: 751901 - protein, 631 aa, Homo sapiens
MGEESLTIFVDKQKLGRKTETTGGASIIGGSGNSTAVSLETLHQLAASYFIDRESTLRRLHHIQIATGAIKVTETRTGPLGCSNYDNLDSVSSVLVQSPENKVQLLGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKERSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 751902 - protein, 156 aa, Homo sapiens
GVPGSRFPRTVTPSTARRDRVPTTLPRESRSAPPHQTRTRSRERPEMSSNDSSLMAGIIYYSQEKYFHHVQQAAAVGLEKFSNDPVLKFFKAYGVLKEGNVLHDAAELLRGPGGGEPDHCDFRELPASPRPEDAAVLSSAGLGADSRNGTQNPRKR

SEQ ID NO: 751903 - protein, 255 aa, Homo sapiens
GVPGSRFPRTVTPSTARRDRVPTTLPRESRSAPPHQTRTRSRERPEMSSNDSSLMAGIIYYSQEKYFHHVQQAAAVGLEKFSNDPVLKFFKAYGVLKEDREAIQELEYSLKEIRKTVSGTALYYAGLFLWLIGRHDKAKEYIDRMLKISRGFREAMYFMMQQNYSEALEVVNQITVTSGSFLPALVLKMQLFLARQDWEQTVEMGHRILEKDESNIDACQILTVHELAREGNMTTVSSLKTQKVILETESRRNPS

SEQ ID NO: 751904 - protein, 333 aa, Homo sapiens
GVPGSRFPRTVTPSTARRDRVPTTLPRESRSAPPHQTRTRSRERPEMSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAYVLRGWVDLTSDKPHTAKKAIEYLEQGIQDTKDVLGLMGKAMYFMMQQNYSEALEVVNQITVTSGSFLPALVLKMQLFLARQDWEQTVEMGHRILEKDESNIDACQILTVHELAREGNMTTVSSLKTQKVILETESRRNPS

SEQ ID NO: 751905 - protein, 285 aa, Homo sapiens
GVPGSRFPRTVTPSTARRDRVPTTLPRESRSAPPHQTRTRSRERPEMSSNDSSLMAGIIYYSQEKYFHHVQQAAAVGLEKFSNDPVLKFFKAYGVLKEEHIQDAISDLESIRHHPDVSLCSTMALIYAHKRCEIIDREAIQELEYSLKEIRKTVSGTALYYAGLFLWLIGRHDKAKEYIDRMLKISRGFREAYVLRGWVDLTSDKPHTAKKAIEYLEQGIQDTKDVLGLMGKAMYFMMQQNYSEALEVVNQITVTSGSFLPALVLKMQLFLARQDWEQTVEMGHR

SEQ ID NO: 751906 - protein, 952 aa, Homo sapiens
VLGTRLGCKSAEAGPVGSPRAPALACWPGHLVNMASATAAAARRGLGRALPLLWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQEFDHFLATKFSTVKRYGGEGAESMMGFFHELLKMSAYSGITDVIIGMPHRGRLNLLTGLLQFPPELMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAMVVCQETDDTYIPLNHMDPNQKGFLEVSNSPLSEEAVLGFEYGMSIESPKLLPLWEAQFGDFFNGAQIIFDTFISGGEAKWLLQSGIVILLPHGYDGAGPDHSSCRIERFLQMCDSAEEGVDGDTVNMFVVHPTTPAQYFHLLRRQMVRNFRKPLIVASPKMLLRLPAAVSTLQEMAPGTTFNPVIGDSSVDPKKVKTLVFCSGKHFYSLVKQRESLGAKKHDFAIIRVEELCPFPLDSLQQEMSKYKHVKDHIWSQEEPQNMGPWSFVSPRFEKQLACKLRLVGRPPLPVPAVGIGTVHLHQHEDILAKTFA

SEQ ID NO: 751907 - protein, 952 aa, Homo sapiens; identical to SEQ ID NO: 751906

SEQ ID NO: 751908 - protein, 800 aa, Homo sapiens
VLGTRLGVNRPRIETSQLQSQDEKDWFAKRFEELQKETFTTEERKHLSKLMLESQEFDHFLATKFSTVKRYGGEGAESMMGFFHELLKMSAYSGITDVIIGMPHRGRLNLLTGLLQFPPELMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAMVVCQETDDTYIPLNHMDPNQKGFLEVSNSPLSEEAVLGFEYGMSIESPKLLPLWEAQFGDFFNGAQIIFDTFISGGEAKWLLQSGIVILLPHGYDGAGPDHSSCRIERFLQMCDSAEEGVDGDTVNMFVVHPTTPAQYFHLLRRQMVRNFRKPLIVASPKMLLRLPAAVSTLQEMAPGTTFNPVIGDSSVDPKKVKTLVFCSGKHFYSLVKQRESLGAKKHDFAIIRVEELCPFPLDSLQQEMSKYKHVKDHIWSQEEPQNMGPWSFVSPRFEKQLACKLRLVGRPPLPVPAVGIGTVHLHQHEDILAKTFA

SEQ ID NO: 751909 - protein, 675 aa, Homo sapiens
MRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAMVVCQETDDTYIPLNHMDPNQKGFLEVSNSPLSEEAVLGFEYGMSIESPKLLPLWEAQFGDFFNGAQIIFDTFISGGEAKWLLQSGIVILLPHGYDGAGPDHSSCRIERFLQMCDSAEEGVDGDTVNMFVVHPTTPAQYFHLLRRQMVRNFRKPLIVASPKMLLRLPAAVSTLQEMAPGTTFNPVIGDSSVDPKKVKTLVFCSGKHFYSLVKQRESLGAKKHDFAIIRVEELCPFPLDSLQQEMSKYKHVKDHIWSQEEPQNMGPWSFVSPRFEKQLACKLRLVGRPPLPVPAVGIGTVHLHQHEDILAKTFA

SEQ ID NO: 751910 - protein, 926 aa, Homo sapiens
VLGTRLGCKSAEAGPVGSPRAPALACWPGHLVNMASATAAAARRGLGRALPLLWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQEFDHFLATKFSTVKRYGGEGAESMMGFFHELLKMSAYSGITDVIIGMPHRGRLNLLTGLLQFPPELMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAMVVCQETDDTYIPLNHMDPNQKGFLEVSNSPLSEEAVLGFEYGMSIESPKLLPLWEAQFGDFFNGAQIIFDTFISGGEAKWLLQSGIVILLPHGYDGAGPDHSSCRIERFLQMCDSAEEGVDGDTVNMFVVHPTTPAQYFHLLRRQMVRNFRKPLIVASPKMLLRLPAAVSTLQEMAPGTTFNPVIGDSSVDPKKVKTLVFCSGKHFYSLVKQRESLGAKKHDFAIIRVEELCPFPLDSLQQEMSKYKHVKDHIWSQEEPQNMGPWSFVSPRFEKQLACKVITRFLW

SEQ ID NO: 751911 - protein, 101 aa, Homo sapiens
AYFFSAIGRDPPDCVSSPSCFYDEKCGFVGCALSGISTLFLLLIICWCVSVPTALAENDSAVKLRACSDCGGKVAAILDLPHMLSPTLANLGPTKYKSLGG

SEQ ID NO: 751912 - protein, 732 aa, Homo sapiens
VLGTRLGCKSAEAGPVGSPRAPALACWPGHLVNMASATAAAARRGLGRALPLLWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQEFDHFLATKFSTVKRYGGEGAESMMGFFHELLKMSAYSGITDVIIGMPHRGRLNLLTGLLQFPPELMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAMVVCQETDDTYIPLNHMDPNQKGFLEVSNSPLSEEAVLGFEYGMSIESPKLLPLWEAQFGDFFNGAQIIFDTFISGEKPSGSYQAAVQTFNCY

SEQ ID NO: 751913 - protein, 385 aa, Homo sapiens
VLGTRLGCKSAEAGPVGSPRAPALACWPGHLVNMASATAAAARRGLGRALPLLWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQEFDHFLATKFSTVKRYGGEGAESMMGFFHELLKMSAYSGITDVIIGMPHRGRLNLLTGLLQFPPELMFRKMRGLSEFPENFSATGDVLSHLTSSVDLYFGAHHPLHVTMLPNPSHLEAVNPVAVGKTRGRQQSRQDGDYSPDNSAQPGDRVICLQVLGASEIEARGGENWEECVGWEG

SEQ ID NO: 751914 - protein, 207 aa, Homo sapiens
SGVCAGLGGACAGPVGSRREPVPRPEPRESSEDSAEAAVSPWASPAAAMGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLLLLV

SEQ ID NO: 751915 - protein, 952 aa, Homo sapiens; identical to SEQ ID NO: 751906

SEQ ID NO: 751916 - protein, 952 aa, Homo sapiens; identical to SEQ ID NO: 751906

SEQ ID NO: 751917 - protein, 695 aa, Homo sapiens
VLGTRLGCKSAEAGPVGSPRAPALACWPGHLVNMASATAAAARRGLGRALPLLWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQEFDHFLATKFSTVKRYGGEGAESMMGFFHELLKMSAYSGITDVIIGMPHRGRLNLLTGLLQFPPELMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAMVVCQETDDTYIPLNHMDPNQKGFLEERPSGSYKAALSSSFHMATMGLGQTTHPVE

SEQ ID NO: 751918 - protein, 1085 aa, Homo sapiens
VLGTRLGCKSAEAGPVGSPRAPALACWPGHLVNMASATAAAARRGLGRALPLLWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQEFDHFLATKFSTVKRYGGEGAESMMGFFHELLKMSAYSGITDVIIGMPHRGRLNLLTGLLQFPPELMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAMVVCQETDDTYIPLNHMDPNQKGFLEVSNSPLSEEAVLGFEYGMSIESPKLLPLWEAQFGDFFNGAQIIFDTFISGGEAKWLLQSGIVILLPHGYDGAGPDHSSCRIERFLQMCDSAEEGVDGDTVNMFVVHPTTPAQYFHLLRRQMVRNFRKPLIVASPKMLLRLPAAVSTLQEMAPGTTFNPVIGDSSVDPKKVKTLVFCSGKHFYSLVKQRESLGAKKHDFAIIRVEELCPFPLDSLQQEMSKYKHVKDHIWSQEEPQNMGPWSFVSPRFEKQLACKSNFVEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQVRNPIFSYADNKTV

SEQ ID NO: 751919 - protein, 84 aa, Homo sapiens
NSPSTHVPSRALPSKPAEEEEDDDMKEFGELGWIHVMGSSAGWAQTDCGGLRSEQACACVGDKYVMLSPTLANLGPTKYKSLGG

SEQ ID NO: 751920 - protein, 69 aa, Homo sapiens
GQALLENVPEIQALVQTLQGPFHTAGMASAQQAGARSCTPGQAPASVLEEAASPLELRLPQCEETRGAC

SEQ ID NO: 751921 - protein, 98 aa, Homo sapiens
MLFPINIWIFELERNVSIPIGWSYFIGWLVLILYFTCAILCYFNHKSFWSLILSHPSGAVSCSSSFGSVEESPRAQTITDTPITQEGVLDPEQKDTHV

SEQ ID NO: 751922 - protein, 142 aa, Homo sapiens
LGAGRGQAGIWRPRPGLRGPSRASRGAAAGRGAARRKCPLGRSQSRAAGAAMSSWPGREDARAGGAWWPREPLDQELQRAREQKRRRHDAQQLQQLKRLESFYEKPPPGLIKVGIANGTVTEQATKNALSLSKTTKSYNSSE

SEQ ID NO: 751923 - protein, 128 aa, Homo sapiens
MISAHRDLRLPGWHCKWYGHRTGYKECPFFIKDNQKLQQFRVAHEDFMYDIIRDNKQHEKNVRIQQLKQLLEDSTSGEDRSSSSSSEGKEKHKKKKKKEKHKKRKKEKKKKKKRKHKSSKSNEGSDSE

SEQ ID NO: 751924 - protein, 299 aa, Homo sapiens
TWGRPRAGGHLAAEAGTSGPLPGESRGGGGKGRRTEEVPSWPQPEPRRRCRDVVLAGARGCEGWGRVVAAGAAGSGTAAGPGAEAAAARRPAAAAAQAPGVLVSLEQPSGPQSARRPFSGNRGARRRVGRWAGSSKPPGPRQGCGPVRNLVPATGLLVLTGWGARPARPRRGPGGRGAGGRGPRPGEAAAACAPRPRFGVGVASFGEAKSYWRLLGICGPNRQVQPSTLPPRSTSEFPGPLRHGETPFFSSSAMEKGRGHGSCSVGVARPGRRENGRRGLATALLERVSPVARSGGSRL

SEQ ID NO: 751925 - protein, 120 aa, Homo sapiens
LGAGRGQAGIWRPRPGLRGPSRASRGAAAGRGAARRKCPLGRSQSRAAGAAMSSWPGREDARAGGAWWPREPLDQELQRAREQKRRRHDAQQLQQLKRLESLKGLTCGQERWLTPVIPAL

SEQ ID NO: 751926 - protein, 142 aa, Homo sapiens; identical to SEQ ID NO: 751922

SEQ ID NO: 751927 - protein, 170 aa, Homo sapiens
TWGRPRAGGHLAAEAGTSGPLPGESRGGGGKGRRTEEVPSWPQPEPRRRCRDVVLAGARGCEGWGRVVAAGAAGSGTAAGPGAEAAAARRPAAAAAQAPGVLKGSHLWPGAVAHACNPSTLRGRGGQITSYEKPPPGLIKVGIANGTVTEQATKNALSLSKTTKSYNSSE

SEQ ID NO: 751928 - protein, 299 aa, Homo sapiens; identical to SEQ ID NO: 751924

SEQ ID NO: 751929 - protein, 120 aa, Homo sapiens; identical to SEQ ID NO: 751925

SEQ ID NO: 751930 - protein, 299 aa, Homo sapiens; identical to SEQ ID NO: 751924

SEQ ID NO: 751931 - protein, 299 aa, Homo sapiens; identical to SEQ ID NO: 751924

SEQ ID NO: 751932 - protein, 299 aa, Homo sapiens; identical to SEQ ID NO: 751924

SEQ ID NO: 751933 - protein, 125 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGEGQTRGETEAPRVFTQTSGQKPLCSCEAGKGMAGTTP

SEQ ID NO: 751934 - protein, 543 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 751935 - protein, 521 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKSWRKQGPPRQLVDNRGGS

SEQ ID NO: 751936 - protein, 517 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYAGILYDIGIEPGPRERTARTVDCIVPAPERVLYRDRMRMALNARGCRHRVSQGKDADMVVSGQDAELVSAGESRRVGSSSTDM

SEQ ID NO: 751937 - protein, 580 aa, Homo sapiens
MRKPAAGFLPSLLKVLLLPLAPAAAQDSTQASTPGSPLSPTEYERFFALLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 751938 - protein, 521 aa, Homo sapiens; identical to SEQ ID NO: 751935

SEQ ID NO: 751939 - protein, 518 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSTPALPLLLPAPPQ

SEQ ID NO: 751940 - protein, 520 aa, Homo sapiens
AGTGPEFWGSPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 751941 - protein, 425 aa, Homo sapiens
MRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 751942 - protein, 423 aa, Homo sapiens
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 751943 - protein, 423 aa, Homo sapiens; identical to SEQ ID NO: 751942

SEQ ID NO: 751944 - protein, 373 aa, Homo sapiens
RRASPGEDERARRPHLPAPPALRARRSDRRSSRAPAAFPPRPPHASPAPGPAMAQAVWSRLGRILWLACLLPWAPAGVAAEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 751945 - protein, 221 aa, Homo sapiens
MLFSLKYLGMTLVEQPKGEELSAAAIKRIVATAKASGKKLQKVTLKVSPRGIILTDNLTNQLIENVSIYRISYCTADKMHDKVFAYIAQSQHNQSLECHAFLCTKRKMAQAVTLTVAQAFKVAFEFWQVSKEEKEKRDKASQEGGDVLGARQDCTPPLKSLVATGNLLDLEETAKAPLSTVSANTTNMDEVPRPQALSGSSVVWVSGCVASRSVILSLTSG

SEQ ID NO: 751946 - protein, 328 aa, Homo sapiens
GKFFLTEFWLRQRRRRPERAMDALKSAGRALIRSPSLAKQSWGGGGRHRKLPENWTDTRETLLEGMLFSLKYLGMTLVEQPKGEELSAAAIKRIVATAKASGKKLQKVTLKVSPRGIILTDNLTNQLIENVSIYRISYCTADKMHDKVFAYIAQSQHNQSLECHAFLCTKRKMAQAVTLTVAQAFKVAFEFWQVSKEEKEKRDKASQEGGDVLGARQDCTPPLKSLVATGNLLDLEETAKAPLSTVSANTTNMDEVPRPQALSGSSVVWELDDGLDEAFSRLAQSRTNPQVLDTGLTAQDMHYAQCLSPVDWDKPDSSGTEQDDLFSF

SEQ ID NO: 751947 - protein, 122 aa, Homo sapiens
MLCLGPAEKEKRDKASQEGGDVLGARQDCTPPLKSLVATGNLLDLEETAKAPLSTVSANTTNMDEVPRPQALSGSSVVWVSGCVASRSACPVSDKPSGPGHWPDSPGHALRPVPLACRLGQA

SEQ ID NO: 751948 - protein, 328 aa, Homo sapiens; identical to SEQ ID NO: 751946

SEQ ID NO: 751949 - protein, 328 aa, Homo sapiens; identical to SEQ ID NO: 751946

SEQ ID NO: 751950 - protein, 221 aa, Homo sapiens; identical to SEQ ID NO: 751945

SEQ ID NO: 751951 - protein, 328 aa, Homo sapiens; identical to SEQ ID NO: 751946

SEQ ID NO: 751952 - protein, 151 aa, Homo sapiens
PHSPLWKTLCSPSSGVCCGFVTLFCNDRFACLFQLTPPPSPAWMTAAASLLASLLPALPPLNLQDAKFVEERRKQLQNYLRSVMNKVIQMVPEFAASPKKETLIQLMPFFVDITPPGEPVNSRPKAASRFPKLSRGQPRETRNVEPQSGDL

SEQ ID NO: 751953 - protein, 182 aa, Homo sapiens
PHSPLWKTLCSPSSGVCCGFVTLFCNDRFACLFQLTPPPSPAWMTAAASLLASLLPALPPLNLQDAKFVEERRKQLQNYLRSVMNKVIQMVPEFAASPKKETLIQLMPFFVYSTAPTDMGRQPCQHFFLGRFGRSGSTAALRDALIAMGPRRTPGAVPGAKVEVGSQRFGASKGMGREQACK

SEQ ID NO: 751954 - protein, 119 aa, Homo sapiens
YTEFRSLHHKLQNKYPQVRAYNFPPKKAIGNKDAKFVEERRKQLQNYLRSVMNKVIQMVPEFAASPKKETLIQLMPFFVDITPPGEPVNSRPKAASRFPKLSRGQPRETRNVEPQSGDL

SEQ ID NO: 751955 - protein, 175 aa, Homo sapiens
PHSPLWKTLCSPSSGVCCGFVTLFCNDRFACLFQLTPPPSPAWMTAAASLLASLLPALPPLNLQDAKFVEERRKQLQNYLRSVMNKVIQMVPEFAASPKKETLIQLMPFFVMGLQVGMYGLFHFGVMMDQPQPSLTRADESPCDRVLSPCAAHRKQRDCCLSWKAEPERFLVKKK

SEQ ID NO: 751956 - protein, 123 aa, Homo sapiens
PIPVGERSESFSGARVWFVVRSSAMSSQQSAVSAKGFSKGSSQGPAPCPAPAPTPAPASSSSCCGSGRGCCGDSGCCGSSSTSCCCFPRRRRRQRSSGCCCCGGGSQRSQRSNNRSSGCCSGC

SEQ ID NO: 751957 - protein, 717 aa, Homo sapiens
CLSSPPVSAVEVATEGRDREVAKVGQRFCDTTSGELRQARDRDCCVRMPAPVGRRSPPSPRSSMAAVALRDSAQGMTFEDVAIYFSQEEWELLDESQRFLYCDVMLENFAHVTSLGYCHGMENEAIASEQSVSIQVRTSKGNTPTQKTHLSEIKMCVPVLKDILPAAEHQTTSPVQKSYLGSTSMRGFCFSADLHQHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSVCSEGGLYECSKCEKAFTCKNTLVQHQQIHTGQKMFECSECEESFSKKCHLILHKIIHTGERPYECSDREKAFIHKSEFIHHQRRHTGGVRHECGECRKTFSYKSNLIEHQRVHTGERPYECGECGKSFRQSSSLFRHQRVHSGERPYQCCECGKSFRQIFNLIRHRRVHTGEMPYQCSDCGKSFSCKSELIQHQRIHSGERPYECRECGKSFRQFSNLIRHRSIHTGDRPYECSECEKSFSRKFILIQHQRVHTGERPYECSECGKSFTRKSDLIQHRRIHTGTRPYECSECGKSFRQRSGLIQHRRLHTGERPYECSECGKSFSQSASLIQHQRVHTGERPYECSECGKSFSQSSSLIQHQRGHTGERPYECSQCGKPFTHKSDLIQHQRVHTGERPYECSECGKSFSRKSNLIRHRRVHTEERP

SEQ ID NO: 751958 - protein, 121 aa, Homo sapiens
CLSSPPVSAVEVATEGRDREVAKVGQRFCDTTSGELRQARDRDCCVRMPAPVGRRSPPSPRSSMAAVALRDSAQGMTFEDVAIYFSQEEWELLDESQRFLYCDVMLENFAHVTSLDQATNI

SEQ ID NO: 751959 - protein, 603 aa, Homo sapiens
EELGWLEVLGCYKIVRRVSIQVRTSKGNTPTQKTHLSEIKMCVPVLKDILPAAEHQTTSPVQKSYLGSTSMRGFCFSADLHQHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSVCSEGGLYECSKCEKAFTCKNTLVQHQQIHTGQKMFECSECEESFSKKCHLILHKIIHTGERPYECSDREKAFIHKSEFIHHQRRHTGGVRHECGECRKTFSYKSNLIEHQRVHTGERPYECGECGKSFRQSSSLFRHQRVHSGERPYQCCECGKSFRQIFNLIRHRRVHTGEMPYQCSDCGKSFSCKSELIQHQRIHSGERPYECRECGKSFRQFSNLIRHRSIHTGDRPYECSECEKSFSRKFILIQHQRVHTGERPYECSECGKSFTRKSDLIQHRRIHTGTRPYECSECGKSFRQRSGLIQHRRLHTGERPYECSECGKSFSQSASLIQHQRVHTGERPYECSECGKSFSQSSSLIQHQRGHTGERPYECSQCGKPFTHKSDLIQHQRVHTGERPYECSECGKSFSRKSNLIRHRRVHTEERP

SEQ ID NO: 751960 - protein, 597 aa, Homo sapiens
MENEAIASEQSVSIQVRTSKGNTPTQKTHLSEIKMCVPVLKDILPAAEHQTTSPVQKSYLGSTSMRGFCFSADLHQHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSVCSEGGLYECSKCEKAFTCKNTLVQHQQIHTGQKMFECSECEESFSKKCHLILHKIIHTGERPYECSDREKAFIHKSEFIHHQRRHTGGVRHECGECRKTFSYKSNLIEHQRVHTGERPYECGECGKSFRQSSSLFRHQRVHSGERPYQCCECGKSFRQIFNLIRHRRVHTGEMPYQCSDCGKSFSCKSELIQHQRIHSGERPYECRECGKSFRQFSNLIRHRSIHTGDRPYECSECEKSFSRKFILIQHQRVHTGERPYECSECGKSFTRKSDLIQHRRIHTGTRPYECSECGKSFRQRSGLIQHRRLHTGERPYECSECGKSFSQSASLIQHQRVHTGERPYECSECGKSFSQSSSLIQHQRGHTGERPYECSQCGKPFTHKSDLIQHQRVHTGERPYECSECGKSFSRKSNLIRHRRVHTEERP

SEQ ID NO: 751961 - protein, 157 aa, Homo sapiens
TYTISLFSVSPLRNYIFLPAKVGGNLCADNTHSSSPIAGFEGNLARNTASESSLPAAAPGRAGGPEPRSLTRVSDPLSLKESENSAQTPWTVQCGREQPRERSTKHSLMSEEEEERSMGRQAFSMAQKRILEASSCIKTGKGHLFQPVYHNKPPTRR

SEQ ID NO: 751962 - protein, 109 aa, Homo sapiens
MQLRARMYFPFEVLLEICALKHGNFGFEGNLARNTASESSLPAAAPGRAGGPEPRSLTRVSDPLSLKESENSAQTPWTVQCGREQPRERSTKHSLMSEEEEERSMGRGI

SEQ ID NO: 751963 - protein, 148 aa, Homo sapiens
MDKNVISVKIMEEKRDESTGVIYRKRIAICQNVVPEILRKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 751964 - protein, 148 aa, Homo sapiens; identical to SEQ ID NO: 751963

SEQ ID NO: 751965 - protein, 132 aa, Homo sapiens
QLPPLGSRRARGSAVSEDASGCVWLLPASGLMPASTSVKTPCPCILPQPGLSVHERRREGGAVAGGSAESPLATMWGTQEQTPATHRAPVSQHRPCAWLQHSSTVSLPSHCMRRPRPGVCFPLGTSWGGNAG

SEQ ID NO: 751966 - protein, 37 aa, Homo sapiens
MRVGFCYQIRRCTDDVRPQGEAQAWGLQSRGWKPGTG

SEQ ID NO: 751967 - protein, 2816 aa, Homo sapiens
AASRGHAMTLEGLYLARGPLARLLLAWSALLCMAGGQGRWDGALEAAGPGRVRRRGSPGILQGPNVCGSRFHAYCCPGWRTFPGRSQCVVPICRRACGEGFCSQPNLCTCADGTLAPSCGVSRGSGCSVSCMNGGTCRGASCLCQKGYTGTVCGQPICDRGCHNGGRCIGPNRCACVYGFMGPQCERDYRTGPCFGQVGPEGCQHQLTGLVCTKALCCATVGRAWGLPCELCPAQPHPCRRGFIPNIHTGACQDVDECQAVPGLCQGGSCVNMVGSFHCRCPVGHRLSDSSAACEDYRAGACFSVLFGGRCAGDLAGHYTRRQCCCDRGRCWAAGPVPELCPPRGSNEFQQLCAQRLPLLPGHPGLFPGLLGFGSNGMGPPLGPARLNPHGSDARGIPSLGPGNSNIGTATLNQTIDICRHFTNLCLNGRCLPTPSSYRCECNVGYTQDVRGECIDVDECTSSPCHHGDCVNIPGTYHCRCYPGFQATPTRQACVDVDECIVSGGLCHLGRCVNTEGSFQCVCNAGFELSPDGKNCVDHNECATSTMCVNGVCLNEDGSFSCLCKPGFLLAPGGHYCMDIDECQTPGICVNGHCTNTEGSFRCQCLGGLAVGTDGRVCVDTHVRSTCYGAIEKGSCARPFPGTVTKSECCCANPDHGFGEPCQLCPAKNSAEFQALCSSGLGITTDGRDINECALDPEVCANGVCENLRGSYRCVCNLGYEAGASGKDCTDVDECALNSLLCDNGWCQNSPGSYSCSCPPGFHFWQDTEICKDVDECLSSPCVSGVCRNLAGSYTCKCGPGSRLDPSGTFCLDSTKGTCWLKIQESRCEVNLQGASLRSECCATLGAAWGSPCERCEIDPACARGFARMTGVTCDDVNECESFPGVCPNGRCVNTAGSFRCECPEGLMLDASGRLCVDVRLEPCFLRWDEDECGVTLPGKYRMDVCCCSIGAVWGVECEACPDPESLEFASLCPRGLGFASRDFLSGRPFYKDVNECKVFPGLCTHGTCRNTVGSFHCACAGGFALDAQERNCTDIDECRISPDLCGQGTCVNTPGSFECECFPGYESGFMLMKNCMDVDECARDPLLCRGGTCTNTDGSYKCQCPPGHELTAKGTACEDIDECSLSDGLCPHGQCVNVIGAFQCSCHAGFQSTPDRQGCVDINECRVQNGGCDVHCINTEGSYRCSCGQGYSLMPDGRACADVDECEENPRVCDQGHCTNMPGGHRCLCYDGFMATPDMRTCVDVDECDLNPHICLHGDCENTKGSFVCHCQLGYMVRKGATGCSDVDECEVGGHNCDSHASCLNIPGSFSCRCLPGWVGDGFECHDLDECISQEHRCSPRGDCLNVPGSYRCTCRQGFAGDGFFCEDRDECAENVDLCDNGQCLNAPGGYRCECEMGFDPTEDHRACQDVDECAQGNLCAFGSCENLPGMFRCICNGGYELDRGGGNCTDINECADPVNCINGVCINTPGSYLCSCPQDFELNPSGVGCVDTRAGNCFLETHDRGDSGISCSAEIGVGVTRASCCCSLGRAWGNPCELCPMANTTEYRTLCPGGEGFQPNRITVILEDIDECQELPGLCQGGDCVNTFGSFQCECPPGYHLSEHTRICEDIDECSTHSGICGPGTCYNTLGNYTCVCPAEYLQVNGGNNCMDMRKSVCFRHYNGTCQNELAFNVTRKMCCCSYNIGQAWNRPCEACPTPISPDYQILCGNQAPGFLTDIHTGKPLDIDECGEIPAICANGICINQIGSFRCECPAGFNYNSILLACEDVDECGSRESPCQQNADCINIPGSYRCKCTRGYKLSPGGACVGQNECREIPNVCSHGDCMDTEGSYMCLCHRGFQASADQTLCMDIDECDRQPCGNGTCKNIIGSYNCLCFPGFVVTHNGDCVDFDECTTLVGQVCRFGHCLNTAGSFHCLCQDGFELTADGKNCVDTNECLSLAGTCLPGTCQNLEGSFRCICPPGFQVQSDHCIDIDECSEEPNLCLFGTCTNSPGSFQCLCPPGFVLSDNGHRCFDTRQSFCFTRFEAGKCSVPKAFNTTKTRCCCSKRPGEGWGDPCELCPQEGSAAFQELCPFGHGAVPGPDDSREDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVDECADGQQDCHARGMECKNLIGTFACVCPPGMRPLPGSGEGCTDDNECHAQPDLCVNGRCVNTAGSFRCDCDEGFQPSPTLTECHDIRQGPCFAEVLQTMCRSLSSSSEAVTRAECCCGGGRGWGPRCELCPLPGTSAYRKLCPHGSGYTAEGRDVDECRMLAHLCAHGECINSLGSFRCHCQAGYTPDATATTCLDMDECSQVPKPCTFLCKNTKGSFLCSCPRGYLLEEDGRTCKDLDECTSRQHNCQFLCVNTVGAFTCRCPPGFTQHHQACFDNDECSAQPGPCGAHGHCHNTPGSFRCECHQGFTLVSSGHGCEDVNECDGPHRCQHGCQNQLGGYRCSCPQGFTQHSQWAQCVDENECALSPPTCGSASCRNTLGGFRCVCPSGFDFDQALGGCQDVDECAGRRGPCSYSCANTPGGFLCGCPQGYFRAGQGHCVSGLGFSPGPQDTPDKEELLSSEACYECKINGLSPRDRPRRSAHRDHQVNLATLDSEALLTLGLNLSHLGRAERILELRPALEGLEGRIRYVIVRGNEQGFFRMHHLRGVSSLQLGRRRPGPGTYRLEVVSHMAGPWGVQPEGQPGPWGQALRLKVQLQLL

SEQ ID NO: 751968 - protein, 111 aa, Homo sapiens
GRGAGATEVLPTKATAVHLQPQGLPRPLPGPLCQPRGPPSYSVFPGDSKKLQCAIPLPPQPRSGRGPVVTVSGQSQAFTSVLHCGLPWRGAGGWQDMAMGNWGGHRAYSSE

SEQ ID NO: 751969 - protein, 691 aa, Homo sapiens
MEGICWWCQIRNLATSFHWTPSAPPITPRESDNPSPAVPVVLSLSPCPGARIATGRACPGALSDHTVIAGVGPSPKEPPASWLAQGPFFLLFTDTNECLSLAGTCLPGTCQNLEGSFRCICPPGFQVQSDHCIDIDECSEEPNLCLFGTCTNSPGSFQCLCPPGFVLSDNGHRCFDTRQSFCFTRFEAGKCSVPKAFNTTKTRCCCSKRPGEGWGDPCELCPQEGSAAFQELCPFGHGAVPGPDDSREDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVDECADGQQDCHARGMECKNLIGTFACVCPPGMRPLPGSGEGCTDDNECHAQPDLCVNGRCVNTAGSFRCDCDEGFQPSPTLTECHDIRQGPCFAEVLQTMCRSLSSSSEAVTRAECCCGGGRGWGPRCELCPLPGTSAYRKLCPHGSGYTAEGRDVDECRMLAHLCAHGECINSLGSFRCHCQAGYTPDATATTCLDMDECSQVPKPCTFLCKNTKGSFLCSCPRGYLLEEDGRTCKDLDECTSRQHNCQFLCVNTVGAFTCRCPPGFTQHHQACFDVNECDGPHRCQHGCQNQLGGYRCSCPQGFTQHSQWAQCVGE

SEQ ID NO: 751970 - protein, 120 aa, Homo sapiens
SAISEDGTCCPQCHWPKTFSITPDALALGSLSFLSPRTLFNVSAGLGCIRDCREYGWSTWVDLHMAILYMCPSASLAASPFVCLFLGSASAGGAGSILNLMESRRPRTQRSRLPCRVFLE

SEQ ID NO: 751971 - protein, 108 aa, Homo sapiens
LYGFFFKIKGLKHDTTSYSFYMQRIKHTDLESPSAVYEHNHVSLRAARLVKYEIRAEALVDGKWQEFRTNQIKQKFGLTTSSCKSHTLKIQTVGIPIYVSFAFIFPAS

SEQ ID NO: 751972 - protein, 563 aa, Homo sapiens
MGSLSNYALLQLTLTAFLTILVQPQHLLAPVFRTLSILTNQSNCWLCEHLDNAEQPELVFVPASASTWWTYSGQWMYERVWYPQAEVQNHSTSSYRKVTWHWEASMEAQGLSFAQVRLLEGNFSLCVENKNGSGPFLGNIPKQYCNQILWFDSTDGTFMPSIDVTNESRNDDDDTSVCLGTRQCSWFAGCTNRTWNSSAVPLIGLPNTQDYKWVDRNSGLTWSGNDTCLYSCQNQTKGLLYQLFRNLFCSYGLTEAHGKWRCADASITNDKGHDGHRTPTWWLTGSNLTLSVNNSGLFFLCGNGVYKGFPPKWSGRCGLGYLVPSLTRYLTLNASQITNLRSFIHKVTPHRCTQGDTDNPPLYCNPKDNSTIRALFPSLGTYDLEKAILNISKAMEQEFSATKQTLEAHQSKVSSLASASRKDHVLDIPTTQRQTACGTVGKQCCLYINYSEEIKSNIQRLHEASENLKNVPLLDWQGIFAKVGDWFRSWGYVLLIVLFCLFIFVLIYVRVFRKSRRSLNSQPLNLALSPQQSAQLLVSETSCQVSNRAMKGLTTHQYDTSLL

SEQ ID NO: 751973 - protein, 104 aa, Homo sapiens
VQARAESSGSEFAIRERDPRSLGPSSLPSCGLPLSSGAAPAAPWRRPREGPAPIRTPDPGGQQRDGPWVPGEETSPSRREYGLDRGHEGGRGREWRVAQLARVV

SEQ ID NO: 751974 - protein, 104 aa, Homo sapiens; identical to SEQ ID NO: 751973

SEQ ID NO: 751975 - protein, 104 aa, Homo sapiens; identical to SEQ ID NO: 751973

SEQ ID NO: 751976 - protein, 104 aa, Homo sapiens; identical to SEQ ID NO: 751973

SEQ ID NO: 751977 - protein, 135 aa, Homo sapiens [sequence omitted]

SEQ ID NO: 751978 - protein, 101 aa, Homo sapiens
FLYFRHGSGMVSLVQLLRRSDLWIEGSRKIKSERIKVQSLQSHKPSVWASKFSLLFFVLRQGLTVSPRLEYSGTVTARCSLNVLGSSDPPSLASQLSLARS

SEQ ID NO: 751979 - protein, 113 aa, Homo sapiens
SCLPKVTRADSGRWPPGWAGPLPPSVRVVLRSSPQPVGGAGGAGETARVGARSGRARPGGRPVGSVARPSLGLQFAFPESANLSMSTSRPCKLRASTLGRVWWSLCHQKCASV

SEQ ID NO: 751980 - protein, 215 aa, Homo sapiens
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 751981 - protein, 448 aa, Homo sapiens
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 751982 - protein, 110 aa, Homo sapiens
AQRGSPCSESHSGTCISILTRGLPGSLSHVQGRPTLGQDRGLALPVWTSLLPRWPGIPEDTSMNTLQIAQVMDPCTLKDGLIGPGTVAGDDRHESLWFSHHLGVFKRLPC

SEQ ID NO: 751983 - protein, 769 aa, Homo sapiens
GDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQATKPSKEMSGSNETSSPVSEKPSASRTSIPVLTSFGARNSSISF

SEQ ID NO: 751984 - protein, 68 aa, Homo sapiens
YELAPHQAHFSSSSDDLEKSVEKIQRDVSHNHRLVPGPELEEKALVLKQLGETLTELKGGSGACECST

SEQ ID NO: 751985 - protein, 453 aa, Homo sapiens
RIELGYLNIRVPFVSFVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQATKPSKEMSGSNETSSPVSEKPSASRTSIPVLTSFGARNSSISF

SEQ ID NO: 751986 - protein, 179 aa, Homo sapiens
GDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRSAWSLEKQMPLQPVRVPALDHLDHEN

SEQ ID NO: 751987 - protein, 769 aa, Homo sapiens; identical to SEQ ID NO: 751983

SEQ ID NO: 751988 - protein, 115 aa, Homo sapiens
MSVCTLSVPVSSLSPGRRCNTFSDSGILGCVPINSNTDEEDVVEEKMVAEGVNKEAKQPAKKKRKKGLRIKGKRRRKKLILAKKFSKDLGSGRPVADAPALLASNDPEQDEESLF

SEQ ID NO: 751989 - protein, 373 aa, Homo sapiens
MTEVLWPAVPNGTDAAFLAGPGSSWGNSTVASTAAVSSSFKCALTKTGFQFYYLPAVYILVFIIGFLGNSVAIWMFVFHMKPWSGISVYMFNLALADFLYVLTLPALIFYYFNKTDWIFGDAMCKLQRFIFHVNLYGSILFLTCISAHRYSGVVYPLKSLGRLKKKNAICISVLVWLIVVVAISPILFYSGTGVRKNKTITCYDTTSDEYLRSYFIYSMCTTVAMFCVPLVLILGCYGLIVRALIYKDLDNSPLRRKSIYLVIIVLTVFAVSYIPFHVMKTMNLRARLDFQTPAMCAFNDRVYATYQVTRGLASLNSCVDPILYFLAGDTFRRRLSRATRKASRRSEANLQSKSEDMTLNILPEFKQNGDTSL

SEQ ID NO: 751990 - protein, 373 aa, Homo sapiens; identical to SEQ ID NO: 751989

SEQ ID NO: 751991 - protein, 373 aa, Homo sapiens; identical to SEQ ID NO: 751989

SEQ ID NO: 751992 - protein, 35 aa, Homo sapiens
MVLGLTEMLRSCLLYALRPHCCHCHRMPFSIRGHL

SEQ ID NO: 751993 - protein, 104 aa, Homo sapiens
ALAGHCGAGGEEKPEVLGVPSEICLQFSPSRCENGDKHPGAVSQLHYCLDYGYSYVAPCEVLSVLRGHAMVLGLTEMLRSCLLYALRPHCCHCHRMPFSIRGHL

SEQ ID NO: 751994 - protein, 104 aa, Homo sapiens; identical to SEQ ID NO: 751993

SEQ ID NO: 751995 - protein, 120 aa, Homo sapiens
LYSNLTLSLFFFIKHSIYVVEDSHRGEEKPEVLGVPSEICLQFSPSRCENGDKHPGAVSQLHYCLDYGYSYVAPCEVLSVLRGHAMVLGLTEMLRSCLLYALRPHCCHCHRMPFSIRGHL

SEQ ID NO: 751996 - protein, 35 aa, Homo sapiens; identical to SEQ ID NO: 751992

SEQ ID NO: 751997 - protein, 35 aa, Homo sapiens; identical to SEQ ID NO: 751992

SEQ ID NO: 751998 - protein, 35 aa, Homo sapiens; identical to SEQ ID NO: 751992

SEQ ID NO: 751999 - protein, 101 aa, Homo sapiens
MERSQVQELLYLGVGVCHPPGTWMSCCTFLSASTCSVIQKSSESILLGVFLRLGFGLNQARVQWHNLIAHYSLNLLDSSSLPTFASQSEPLCPAPFGFFFF

SEQ ID NO: 752000 - protein, 44 aa, Homo sapiens
RDLVLGKARRLVKAALLGRPESCTNVLSTFFSCWGSARQDESVG

SEQ ID NO: 752001 - protein, 118 aa, Homo sapiens [sequence omitted]

SEQ ID NO: 752002 - protein, 223 aa, Homo sapiens
MGTASRSNIARHLQTNLILFCVGAVGACTLSVTQPWYLEVDYTHEAVTIKCTFSATGCPSEQPTCLWFRYGAHQPENLCLDGCKSEADKFTVREALKEICGIAFPSVPEARAKQTGGGTTLVVREIKLLSKELRSFLTALVSLLSVYVTGVCVAFILLSKSKSNPLRNKEIKEDSQKKKSARRIFQEIAQELYHKRHVETNQQSEKDNNTYENRRVLSNYERP

SEQ ID NO: 752003 - protein, 241 aa, Homo sapiens
MGTASRSNIARHLQTNLILFCVGAVGACTLSVTQPWYLEVDYTHEAVTIKCTFSATGCPSEQPTCLWFRYGAHQPENLCLDGCKSEADKFTVREALKENQVSLTVNRVTSNDSAIYICGIAFPSVPEARAKQTGGGTTLVVREIKLLSKELRSFLTALVSLLSVYVTGVCVAFILLSKSKSNPLRNKEIKEDSQKKKSARRIFQEIAQELYHKRHVETNQQSEKDNNTYENRRVLSNYERP

SEQ ID NO: 752004 - protein, 185 aa, Homo sapiens
MGTASRSNIARHLQTNLILFCVGAVGACTLSVTQPWYLEVDYTHEAVTIKCTFSATGCPSEQPTCLWFRYGAHQPENLCLDGCKSEADKFTVREALKENQVSLTVNRVTSNDSAIYICGIAFPSVPEARAKQTGGGTTLVVREIKLLSKELRSFLTALVSLLSVYVTGVCVAFILLSKSRARRIF

SEQ ID NO: 752005 - protein, 411 aa, Homo sapiens
TLSSARELRGAGRGAEAGLSSGGAAQEAPQADPRPWLARMKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQHLSSFDPCFYRDLLLVHRFLPYEMLLMWDALNQPNLTCGNQTQIY

SEQ ID NO: 752006 - protein, 397 aa, Homo sapiens
SLAAGQTQGAAQEAPQADPRPWLARMKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQHLSSFDPCFYRDLLLVHRFLPYEMLLMWDALNQPNLTCGNQTQIY

SEQ ID NO: 752007 - protein, 397 aa, Homo sapiens; identical to SEQ ID NO: 752006

SEQ ID NO: 752008 - protein, 397 aa, Homo sapiens; identical to SEQ ID NO: 752006

SEQ ID NO: 752009 - protein, 191 aa, Homo sapiens [sequence omitted]

SEQ ID NO: 752010 - protein, 419 aa, Homo sapiens
SLAAGQTQGAAQEAPQADPRPWLARMKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQHLSSLGAPIPVFPKNSENSTGAGMIFNGPKANRHMPHYCLEKGEIQVLQQPPSPSMFYRLRGDRVSQ

SEQ ID NO: 752011 - protein, 221 aa, Homo sapiens
SLAAGQTQGAAQEAPQADPRPWLARMKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVRWTGVT

SEQ ID NO: 752012 - protein, 849 aa, Homo sapiens
VALTTSMCCNKQVIVIDKIKSASIADRCGALHVGDHILSIDGTSMEYCTLAEATQFLANTTDQVKLEILPHHQTRLALKGPDHVKIQRSDRQLTWDSWASNHSSLHTNHHYNTYHPDHCRVPALTFPKAPPPNSPPALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTEGTSFQASGYNFNTYDWRSPKQRGSLSPVTKPRSQTYPDVGLSYEDWDRSTASGFAGAADSAETEQEENFWSQALEDLETCGQSGILRELEATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 752013 - protein, 864 aa, Homo sapiens
VALTTSMCCNKQVIVIDKIKSASIADRCGALHVGDHILSIDGTSMEYCTLAEATQFLANTTDQVKLEILPHHQTRLALKGPDHVKIQRSDRQLTWDSWASNHSSLHTNHHYNTYHPDHCRVPALTFPKAPPPNSPPALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTEGTSFQASGYNFNTYDWRSPKQRGSLSPVTKPRSQTYPDVGLSYEDWDRSTASGFAGAADSAETEQEENFWSQALEDLETCGQSGILRELEEKADRRVSLRNMTLLATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 752014 - protein, 205 aa, Homo sapiens
MPQATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 752015 - protein, 226 aa, Homo sapiens
MRTEVRVLSPHKRICLIPVLRQEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMGESCPNQRL

SEQ ID NO: 752016 - protein, 110 aa, Homo sapiens
MSCQQNQQQCQPPPKCPPKCTPKCPPKCPPKCLPQCPAPCSPAVSSCCGPISGGCCGPSSGGCCNSGAGGCCLSHHRPRLFHRRRHQSPDCCESEPSGGSGCCHSSGGCC

SEQ ID NO: 752017 - protein, 542 aa, Homo sapiens
GDGALTGGAAAARARRAIGYRPRQRQLGDPACAGPAGRAGVTWAAAMEEQREALRKIIKTLAVKNEEIQSFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPVPSAPVIDLAESLVADNCVTLVWRMPDEDSKIDHYVLEYRRTNFEGPPRLKEDQPWMVIEGIRQTEYTLTGLKFDMKYMNFRVKACNKAVAGEFSEPVTLETPAFMFRLDASTSHQNLRVDDLSVEWDAMGGKVQDIKAREKDGKGRTASPINSPARGTPSPKRMPSGRGGRDRFTAESYTVLGDTLIDGGEHYWEVRYEPDSKAFGVGVAYRSLGRFEQLGKTAASWCLHVNNWLQVSFTAKHANKVKVLDAPVPDCLGVHCDFHQGLLSFYNARTKQVLHTFKTRFTQPLLPAFTVWCGSFQVTTGLQVPSAVRCLQKRGSATSSSNTSLT

SEQ ID NO: 752018 - protein, 534 aa, Homo sapiens
GDGALTGGAAAARARRAIGYRPRQRQLGDPACAGPAGRAGVTWAAAMEEQREALRKIIKTLAVKNEEIQSFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPVPSAPVIDLAESLVADNCVTLVWRMPDEDSKIDHYVLEYRRTNFEGPPRLKEDQPWMVIEGIRQTEYTLTGLKFDMKYMNFRVKACNKAVAGEFSEPVTLETPAFMFRLDASTSHQNLRVDDLSVEWDAMGGKVQDIKAREKDGKGRTASPINSPARGTPSPKRMPSGRGGRDRFTAESYTVLGDTLIDGGEHYWEVRYEPDSKAFGVGVAYRSLGRFEQLGKTAASWCLHVNNWLQVSFTAKHANKVKVLDAPVPDCLGLLSFYNARTKQVLHTFKTRFTQPLLPAFTVWCGSFQVTTGLQVPSAVRCLQKRGSATSSSNTSLT

SEQ ID NO: 752019 - protein, 317 aa, Homo sapiens
GDGALTGGAAAARARRAIGYRPRQRQLGDPACAGPAGRAGVTWAAAMEEQREALRKIIKTLAVKNEEIQSFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPVPSAPVIDLAESLVADNCVTLVWRMPDEDSKIDHYVLEYRRTNFEGPPRLKEDQPWMVIEGIRQTEYTLTGLKFDMKYMNFRVKACNKAVAGEFSEPVTLETPEPAGG

SEQ ID NO: 752020 - protein, 222 aa, Homo sapiens
GDGALTGGAAAARARRAIGYRPRQRQLGDPACAGPAGRAGVTWAAAMEEQREALRKIIKTLAVKNEEIQSFIYSLKQMLLNVEWEVRYEPDSKAFGVGVAYRSLGRFEQLGKTAASWCLHVNNWLQVSFTAKHANKVKVLDAPVPDCLGVHCDFHQGLLSFYNARTKQVLHTFKTRFTQPLLPAFTVWCGSFQVTTGLQVPSAVRCLQKRGSATSSSNTSLT

SEQ ID NO: 752021 - protein, 483 aa, Homo sapiens
GDGALTGGAAAARARRAIGYRPRQRQLGDPACAGPAGRAGVTWAAAMEEQREALRKIIKTLAVKNEEIQSFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPVPSAPVIDLAESLVADNCVTLVWRMPDEDSKIDHYVLEYRRTNFEGPPRLKEDQPWMVIEGIRQTEYTLTGLKFDMKYMNFRVKACNKAVAGEFSEPVTLETPAFMFRLDASTSHQNLRVDDLSVEWDAMGGKVQDIKAREKDGKGRTASPINSPARGTPSPKRMPSGRGGRDRFTAESYTVLGDTLIDGGEHYWEVRYEPDSKAFGVGVAYRSLGRFEQLGKTAASWCLHVNNWLQASCPSTMPAPNKCCTLSRPGSHSRCCLLSRYGVAASR

SEQ ID NO: 752022 - protein, 375 aa, Homo sapiens
MEPLCGHAPKIVQHVVGQPCSKPPGPLNQAQNPDPLSFPSWSVPSAPVIDLAESLVADNCVTLVWRMPDEDSKIDHYVLEYRRTNFEGPPRLKEDQPWMVIEGIRQTEYTLTGLKFDMKYMNFRVKACNKAVAGEFSEPVTLETPAFMFRLDASTSHQNLRVDDLSVEWDAMGGKVQDIKAREKDGKGRTASPINSPARGTPSPKRMPSGRGGRDRFTAESYTVLGDTLIDGGEHYWEVRYEPDSKAFGVGVAYRSLGRFEQLGKTAASWCLHVNNWLQVSFTAKHANKVKVLDAPVPDCLGVHCDFHQGLLSFYNARTKQVLHTFKTRFTQPLLPAFTVWCGSFQVTTGLQVPSAVRCLQKRGSATSSSNTSLT

SEQ ID NO: 752023 - protein, 95 aa, Homo sapiens
VKNEEIQSFIYSLKQMLLNVERRWGSPGEVRGGEEAGGCSLRNWPIAVDACGRSQVPSLNTGFGRFWLFRPRRTRRRCRRTSKQSSSPSSPSWRS

SEQ ID NO: 752024 - protein, 107 aa, Homo sapiens
MKLQGADVTGLHSREGEGKREHITETAQNKQPMKNNLEKEAKNEQQTGPCFLQQEAPTHCWSQPAVWTCRLRDEVGLQGTRGFWLLLVVAFLLTLCSPQNREGHPSG

SEQ ID NO: 752025 - protein, 136 aa, Homo sapiens
HPKPACILPPPSADPMSVWQLPHSLSLERSLPPRHRRPTLPGVVRPGTGSFGFLDAWPGLGKTRCLPCCPHLGDSAPCAPSFLMVSRLVPLACSLLVPTPHGSLRQLHDNPTRAEDLGQRSNHRSSPPFPFLRRQD

SEQ ID NO: 752026 - protein, 205 aa, Homo sapiens
MCPSGWSRRRPCGGHRLGGQSPRNSEPCGFWKRSRAARSRRLQGAERGAARGRECSRPSTQMLTLQNAPRVLEPWGSRRCSPETAAAGAGRSPAGATRVRSRPRTTRRPRPRRDSFSVPISQGAKEAEGAPDSLGSDPDPSLLQGGVLLPEKPRRSFGRPRDTRGHHLPLTGAPRGDFTQCPVSSRWDPPAPEGRPCPPAPQGRE

SEQ ID NO: 752027 - protein, 80 aa, Homo sapiens
VSWRYLKCTRFPALQESLKEGLTVQERLKLFESRDLKKDWCVPSKLSTRLPQLAAAHPKRCFSPVPLFYYYYYYCCCCHR

SEQ ID NO: 752028 - protein, 492 aa, Homo sapiens
MKMTFYGHFVAGEDQESIQPLLRHYRAFGVSAILDYGVEEDLSPEEAEHKEMESCTSAAERDGSGTNKRDKQYQAHRAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHQVYFGQLLGMCDQISFPLGQAGYPVYKYVPYGPVMEVLPYLSRRALENSSLMKGTHRERQLLWLELLRRLRTGNLFHRPA

SEQ ID NO: 752029 - protein, 600 aa, Homo sapiens [sequence omitted]

SEQ ID NO: 752030 - protein, 117 aa, Homo sapiens
MDLLDWSSLIDSRTKLSKHLVVPNAQTGQLEPLLSRFTEEEELQMTRMLQRMDVLAKVSCPARAEGTWDSWRRGHLPHLSNSCSHSPTPCASQKATEMGVRLMVDAESAALDPLDTS

SEQ ID NO: 752031 - protein, 278 aa, Homo sapiens
MLQRMDVLAKVSCPARAEGTWDSWRRGHLPHLSNSCSHSPTPCASQKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHQVYFGQLLGMCDQISFPLGQAGYPVYKYVPYGPVMEVLPYLSRRALENSSLMKGTHRERQLLWLELLRRLRTGNLFHRPA

SEQ ID NO: 752032 - protein, 325 aa, Homo sapiens
MDLLDWSSLIDSRTKLSKHLVVPNAQTGQLEPLLSRFTEEEELQMTRMLQRMDVLAKVSCPARAEGTWDSWRRGHLPHLSNSCSHSPTPCASQKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHQVYFGQLLGMCDQISFPLGQAGYPVYKYVPYGPVMEVLPYLSRRALENSSLMKGTHRERQLLWLELLRRLRTGNLFHRPA

SEQ ID NO: 752033 - protein, 353 aa, Homo sapiens
MALRRALPALRPCIPRFVQLSTAPASREQPAAGPAAVPGGGSATAVRPPVPAVDFGNAQEAYRSRRTWELARSLLVLRLCAWPALLARHEQLLYVSRKLLGQRLFNKLMKMTFYGHFVAGEDQESIQPLLRHYRAFGVSAILDYGVEEDLSPEEAEHKEMESCTSAAERDGSGTNKRDKQYQAHRAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQVTPPLLSEAQLSRALR

SEQ ID NO: 752034 - protein, 245 aa, Homo sapiens [sequence omitted]

SEQ ID NO: 752035 - protein, 353 aa, Homo sapiens; identical to SEQ ID NO: 752033

SEQ ID NO: 752036 - protein, 278 aa, Homo sapiens; identical to SEQ ID NO: 752031

SEQ ID NO: 752037 - protein, 357 aa, Homo sapiens
MALRRALPALRPCIPRFVQLSTAPASREQPAAGPAAVPGGGSATAVRPPVPAVDFGNAQEAYRSRRTWELARSLLVLRLCAWPALLARHEQLLYVSRKLLGQRLFNKLMKMTFYGHFVAGEDQESIQPLLRHYRAFGVSAILDYGVEEDLSPEEAEHKEMESCTSAAERDGSGTNKRDKQYQAHRAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLSPAVPFTEGSSVNGTD

SEQ ID NO: 752038 - protein, 113 aa, Homo sapiens
MQTPSCWCAGKESRRSPDEAQHFTDRQWSRGIQLTLWLNFRKPPMRSCKGDGENMAECQQEQSGERTLVRGPKNRRCEPREGPARPMLQAIWRLNLRLSRINCCMRCGVWEKA

SEQ ID NO: 752039 - protein, 75 aa, Homo sapiens
RKFIPVLQGVCFQNGAHFGGGKAWLSSFKATSNFSLLFDFLQILSCAGGNKGCTSLFTYTGETCSEDSRSKLGQS

SEQ ID NO: 752040 - protein, 177 aa, Homo sapiens
STVSRDDHIPGIPSLTDCLQWFTRPEHLGSSAKIKCNSCQSYQESTKQLTMKKLPIVACFHLKRFEHVGKQRRKINTFISFPLELDMTPFLASTKESRMKEGQPPTDCVPNENKYSLFAVINHHGTLESGHYTSFIRQQKDQWFSCDDAIITKATIEDLLYSEGYLLFYHKQGLEKD

SEQ ID NO: 752041 - protein, 856 aa, Homo sapiens
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 752042 - protein, 960 aa, Homo sapiens
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLSSNYIAQISNGQQLMSQPQLHRRSNSCSSISVASCISEWEQKIPTYNTPLKVTSIARRRQQEPGQSKTCIVSDRRRGMYWTEGREVVPTFRNEIEIEEDHCGRLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 752043 - protein, 656 aa, Homo sapiens
WYGPEPLVSWMQMRDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLSSNYIAQISNGQQLMSQPQLHRRSNSCSSISVASCISEWEQKIPTYNTPLKVTSIARRRQQEPGQSKTCIVSDRRRGMYWTEGREVVPTFRNEIEIEEDHCGRLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 752044 - protein, 596 aa, Homo sapiens
MTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLSSNYIAQISNGQQLMSQPQLHRRSNSCSSISVASCISEWEQKIPTYNTPLKVTSIARRRQQEPGQSKTCIVSDRRRGMYWTEGREVVPTFRNEIEIEEDHCGRLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 752045 - protein, 960 aa, Homo sapiens; identical to SEQ ID NO: 752042

SEQ ID NO: 752046 - protein, 880 aa, Homo sapiens
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLSSNYIAQISNGQQLMSQPQLHRRSNSCSSISVASCISEWEQKIPTYNTPLKVTSIARRRQQEPGQSKTCIVSDRRRGMYWTEGREVVPTFRNEIEIEEDHCGRLLFQPDQNAPPIRLRHRRSRSAGDRWVDHKPASNMQTETVMQPHVPHAITVSVANEKALAKCEKYMLTHQELASDGEIETKLIKVKN

SEQ ID NO: 752047 - protein, 876 aa, Homo sapiens
VLLNHSPNDWNKRKKKKKKAMKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 752048 - protein, 596 aa, Homo sapiens; identical to SEQ ID NO: 752044

SEQ ID NO: 752049 - protein, 960 aa, Homo sapiens; identical to SEQ ID NO: 752042

SEQ ID NO: 752050 - protein, 960 aa, Homo sapiens; identical to SEQ ID NO: 752042

SEQ ID NO: 752051 - protein, 243 aa, Homo sapiens
SLYNGVLKHQFFSGLLKNLNIQARCGGSLPAIPTFWEAKAGRFLELEFENRLCNSDGFIGALPLVPEFLILNMSETAPAAPAAAPPAEKAPVKKKAAKKAGGTPRKASGPPVSELITKAVAASKERSGVSLAALKKALAAAGYDVEKNNSRIKLGLKSLVSKGTLVQTKGTGASGSFKLNKKAASGEAKPKVKKAGGTKPKKPVGAAKKPKKAAGGATPKKSAKKTPKKAKKAGRGHCNQESG

SEQ ID NO: 752052 - protein, 243 aa, Homo sapiens; identical to SEQ ID NO: 752051

SEQ ID NO: 752053 - protein, 243 aa, Homo sapiens; identical to SEQ ID NO: 752051

SEQ ID NO: 752054 - protein, 109 aa, Homo sapiens
DSTEEVDSTEAGTEEVDSWTAHGQHRGGGQHMDSTEEVDSTEEVDSTEEVAAQWWPLTGRRMQCCRLFCFLLQNCLFPFPLHLIQHDPCELVLTISWDWAEAGASLYSP

SEQ ID NO: 752055 - protein, 68 aa, Homo sapiens
VSATIFMKNMICGWEGGYGKRRKLAGIADISALAPLRSLSVVEQGSPSQPQELFFLNFITSLFRFQSS

SEQ ID NO: 752056 - protein, 102 aa, Homo sapiens
TTTKFAAASTFSRIPKTMHWSGQELSHIPLQTGHSMFSVTVRTSQASAVPFLPLQHTHLSGREEMSFQPQEWRLPHPNIVSIEKEAVCIYDYISVHLYIFDM

SEQ ID NO: 752057 - protein, 129 aa, Homo sapiens
MTSPPQLPQCDVPACHPVLQPRAPLGSARTADLQSRPVSGAAWSFRGVTLWGSWPPASWKHPLEPRLGQHCMALLCFLPGAISLILCLREFCLSSLERPLPLFLYRGAASFFLPPSFLPIKFLLLKTKR

SEQ ID NO: 752058 - protein, 99 aa, Homo sapiens
MPCCDSVVDWAPLGDSPAAASRWWLGLESTQCRTGLGSHADGIFTRVWGSWTAEGLLSIAVSALPSSIPVASSHRAPLDALTACWSLGSQTPSMVCGFP

SEQ ID NO: 752059 - protein, 74 aa, Homo sapiens
HLLLPVQLLLPGLLRVPPLPPRKLPPGLLQPLLRQEVQLLSAQSLSPADCVFAAKQDSPVSGAPGVLRIHQLHQ

SEQ ID NO: 752060 - protein, 265 aa, Homo sapiens
STEQTAQLGTELFIVRQLLQIVKQKTNQNSVDTTLKFTLSALWNLTDESPTTCRHFIENQGLELFMRVLESFPTESSIQQKVLGLLNNIAEVQELHSELMWKDFIDHISSLLHSVEVEVSYFAAGIIAHLISRGEQAWTLSRSQRNSLLDDLHSAILKWPTPECEMVAYRSFNPFFPLLGCFTTPGVQLWAVWAMQHVCSKNPSRYCSMLIEEGGLQHLYNIKDHEHTDPHVQQIAVAILDSLEKHIVRHGRPPPCKKQPQARLN

SEQ ID NO: 752061 - protein, 295 aa, Homo sapiens
STEQTAQLGTELFIVRQLLQIVKQKTNQNSVDTTLKFTLSALWNLTDESPTTCRHFIENQGLELFMRVLESFPTESSIQQKVLGLLCGSADDEFFSFCLTENIFTYTFVFERYFYQNNIAEVQELHSELMWKDFIDHISSLLHSVEVEVSYFAAGIIAHLISRGEQAWTLSRSQRNSLLDDLHSAILKWPTPECEMVAYRSFNPFFPLLGCFTTPGVQLWAVWAMQHVCSKNPSRYCSMLIEEGGLQHLYNIKDHEHTDPHVQQIAVAILDSLEKHIVRHGRPPPCKKQPQARLN

SEQ ID NO: 752062 - protein, 166 aa, Homo sapiens
MWKDFIDHISSLLHSVEVEVSYFAAGIIAHLISRGEQAWTLSRSQRNSLLDDLHSAILKWPTPECEMVAYRSFNPFFPLLGCFTTPGVQLWAVWAMQHVCSKNPSRYCSMLIEEGGLQHLYNIKDHEHTDPHVQQIAVAILDSLEKHIVRHGRPPPCKKQPQARLN

SEQ ID NO: 752063 - protein, 562 aa, Homo sapiens
SLFSELACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 752064 - protein, 562 aa, Homo sapiens; identical to SEQ ID NO: 752063

SEQ ID NO: 752065 - protein, 599 aa, Homo sapiens [sequence omitted]

SEQ ID NO: 752066 - protein, 691 aa, Homo sapiens [sequence omitted]

SEQ ID NO: 752067 - protein, 247 aa, Homo sapiens [sequence omitted]

SEQ ID NO: 752068 - protein, 766 aa, Homo sapiens
MYSEWRSLHLVIQNDQGHTSVLHSYPESVGREVANAVVRPLGQVLGTPSVAGSENLLKTDKEVKWTMEVICYGLTLPLDGETVKYCVDVYTDWIMALVLPKDSIPLPVIKEPNQYVQTILKHLQNLFVPRQEQGSSQIRLCLQVLRAIQKLARESSLMARETWEVLLLFLLQINDILLAPPTVQGGIAENLAEKLIGVLFEVWLLACTRCFPTPPYWKTAKEMVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYALNTDSAAGLLIRSIHLV

SEQ ID NO: 752069 - protein, 84 aa, Homo sapiens
MLCAFHGLPPGPARAVSFWNALLAALWAVRLTRIQQDLTDLPRECGGSCGNRVSPHSSEFLEGRIGAEPLLVFRRYFQCLAQRQ

SEQ ID NO: 752070 - protein, 110 aa, Homo sapiens
PPQHPQVPWPQGQSSSQPQLGHPCSLCPGCAPPAPSGPSTTQPRPPSVQPSGGGGGGSGGGGSSSSSNSSAGGGAGKQNGATSYSSVVADSPAEVALSSSGGNNASSQAL

SEQ ID NO: 752071 - protein, 121 aa, Homo sapiens
MEWAACGVLSRWKRYHIKVHLADEALLLPLTVRPRDTLSDLRAQLVGQGVSSWKRAFYYNARRLDDHQTVRDARLQDGSVLLLVSDPSEAQRLTPAIPALWEAEASRSLESRSSRPAWPTW

SEQ ID NO: 752072 - protein, 181 aa, Homo sapiens
MKPWPDQLMHTASDTPAGAPVPDKDLGHFCSCPAYREGALSLSALLCDFEVVAPLLGPWVPCLQWKALCHLGKLPWAARGHRKKRKHRRGRRDTQRHFRSCPGHSPSHTFAQAVPPAWSTFQPLLCSSNTPGIAVSSRKSSQIPSFPAREHLAFFGAPTGPLCSEQPWLGVQPVVSELSND

SEQ ID NO: 752073 - protein, 61 aa, Homo sapiens
LRAQLVGQGVSSWKRAFYYNARRLDDHQTVRDARLQDGSVLLLVSDPRWPRGSGWGGAGAA

SEQ ID NO: 752074 - protein, 118 aa, Homo sapiens
AAGAGGQASRAGARGARGPGPELEPEPGGRHGVGCGGVLSRWKRYHIKVHLADEALLLPLTVRPRDTLSDLRAQLVGQGVSSWKRAFYYNARRLDDHQTVRDARLQDGSVLLLVSDPR

SEQ ID NO: 752075 - protein, 118 aa, Homo sapiens; identical to SEQ ID NO: 752074

SEQ ID NO: 752076 - protein, 108 aa, Homo sapiens
ASRVGTWPWCLISFWTNTWTRAVLPLTCWVTLGKLLLLSGLCYLSPYNKGLSFDLALLHSLPAIPVTAIRWQKTAKFQENRLNPGVRGYSEPKSRHCTPAWRQSRTLS

SEQ ID NO: 752077 - protein, 163 aa, Homo sapiens
MVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLS

SEQ ID NO: 752078 - protein, 219 aa, Homo sapiens
MPLTPTVQGFQWTLRGPDVETSPFGAPRAASHGVGRHQELRDPTVPGPTSSATNVSMVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLS

SEQ ID NO: 752079 - protein, 163 aa, Homo sapiens; identical to SEQ ID NO: 752077

SEQ ID NO: 752080 - protein, 106 aa, Homo sapiens
MVWADIKSCEIQQGALGGARITDGIGQCMEMVQQDEVSLEDSVECRETCFEMGLIQSSFLHYHMNAGQPRITLTAPSTQASPAANLRRPGLQNSLPSSRLTKPRWG

SEQ ID NO: 752081 - protein, 42 aa, Homo sapiens
MPRTRTNSEDENAALCQDWLPSPVSVPHWFLKLFEFETAGVT

SEQ ID NO: 752082 - protein, 113 aa, Homo sapiens
EWTNGLLKTHLTKLSHQLKKDWTILLPLALLRIRACLRNATGYSPFELLYRCSFLLGPSLIPDTRPTWTAPPKTCHPYYLLSSHTPIHHSQLLIHALLLFTLPVYTVSPSHHS

SEQ ID NO: 752083 - protein, 243 aa, Homo sapiens
MESGKMASPKSMPKDAQMMAQILKDLGITEYEPRLINQMLEFAFRYVTTILDDAKIYSSHAKKATVDADDVQLAIQFHADQSFTSLPPRDFLLDIARQRNQTPFPLIKPYSGPRLPPDRYCLTAPNYRLKSLQKKASTSTGRVTVPQLSVGSVASRPSTPTLGTPTPQTMSVSTKVGTPVSFTGQRFTVQMPTSQSPAVKSSIPATSAVQNVLINPSLIGSKSFLLPLIRCYHKILPMNHQMH

SEQ ID NO: 752084 - protein, 159 aa, Homo sapiens
CWYYRCEPLHPSKSFFSSRFQEASFPVLKDGAKFSNVPHAVPTKSSFSFLFWASLGPCTCCHLCLGFSSAGLSRPSLHPLPSLPRPLPVLAGATAWTSLAYLLLVSCHLPCLNVSSLRTRTPSCVLNPARLQPFISGWCGAVFGRLLEGPSRLCEGPSC

SEQ ID NO: 752085 - protein, 213 aa, Homo sapiens
QGLIVMSTSLEEIFNCIFDAHVPPLWGKAYPSQKPLAAWTRDLAMRVEQFELWASRARPPVIFWLSGFTFPTGFLTAVLQSSARQNNVSVDSLSWEFIVSTVDDSNLVYPPKDGVWVRGLYLEGAGWDRKNSCLVEAEPMQLVCLMPTIHFRPAESRKKSAKGMYSCPCYYYPNRAGSSDRASFVIGIDLRSGAMTPDHWIKRGTALLMSLDS

SEQ ID NO: 752086 - protein, 75 aa, Homo sapiens
HELGVYYLPDAEGAFRRGPGLNLTSGQYRAPVAGFYALAATLHVALGEPPRRGPPRPRDHLRLLICIQSRCQRNA

SEQ ID NO: 752087 - protein, 81 aa, Homo sapiens
EDGTWPIPKPGGHHLRLLVPLSVPAATSCEPGQGKASSEHCLAWARGALDKGLWGTVSLGPASSSNVCKINSLCIHWAQIF

SEQ ID NO: 752088 - protein, 237 aa, Homo sapiens
HELGVYYLPDAEGAFRRGPGLNLTSGQYRAPVAGFYALAATLHVALGEPPRRGPPRPRDHLRLLICIQSRCQRNASLEAIMGLESSSELFTISVNGVLYLQVSVLSSWACERPPQALPPQGQMEHRSRQCVDSVRVAVATWRRRPTRNSAHTGHCSSAHRATAGRPTDVTRTLVVPEPGLIQDTILDSFLACSAPAQMASASFLCPAPPFPPLFMFSWSAKCTSQGPYLGEGQLTQG

SEQ ID NO: 752089 - protein, 265 aa, Homo sapiens
GGSRGDHPCPSQPDAEGAFRRGPGLNLTSGQYRAPVAGFYALAATLHVALGEPPRRGPPRPRDHLRLLICIQSRCQRNASLEAIMGLESSSELFTISVNGVLYLQVWGSGPPCSWTTPAAAPSQCAVAPTSVLSSWACERPPQALPLRGKWSTDLDNVLDSVRVAVATWRRRPTRNSAHTGHCSSAHRATAGRPTDVTRTLVVPEPGLIQDTILDSFLACSAPAQMASASFLCPAPPFPPLFMFSWSAKCTSQGPYLGEGQLTQG

SEQ ID NO: 752090 - protein, 72 aa, Homo sapiens
RGVRPGGSRGDHPCPSQPDAEGAFRRGPGLNLTSGQYRAPVAGFYALAATLHVGEARGVGGSPALSPTPPPA

SEQ ID NO: 752091 - protein, 85 aa, Homo sapiens
RAESVLSLLASRLSRLLRVFIRLLGDLSREGGCAFIRSRPGLGRLLPGAQKPQGRGGAGLCLRPGQSGAGTAQGALFPGRLISAS

SEQ ID NO: 752092 - protein, 392 aa, Homo sapiens
MGVNQSVGFPPVTGPHLVGCGDVMEGQNLQGSFFRLFYPCQKAEETMEQPLWIPRYEYCTGLAEYLQFNKRCGGLLFNLAVGSCRLPVSWNGPFKTKDSGYPLIIFSHGLGAFRTLYSAFCMELASRGFVVAVPEHRDRSAATTYFCKQAPEENQPTNESLQEEWIPFRRVEEGEKEFHVRNPQVHQRVSECLRVLKILQEVTAGQTVFNILPGGLDLMTLKGNIDMSRVAVMGHSFGGATAILALAKETQFRCAVALDAWMFPLERDFYPKARGPVFFINTEKFQTMESVNLMKKICAQHEQSRIITVLGSVHRSQTDFAFVTGNLIGKFFSTETRGSLDPYEGQEVMVRAMLAFLQKHLDLKEDYNQWNNLIEGIGPSLTPGAPHHLSSL

SEQ ID NO: 752093 - protein, 432 aa, Homo sapiens
ITHFRQQEAERKPASGCCSVFPHPASKFSSGKSFDSPGDEMGVNQSVGFPPVTGPHLVGCGDVMEGQNLQGSFFRLFYPCQKAEETMEQPLWIPRYEYCTGLAEYLQFNKRCGGLLFNLAVGSCRLPVSWNGPFKTKDSGYPLIIFSHGLGAFRTLYSAFCMELASRGFVVAVPEHRDRSAATTYFCKQAPEENQPTNESLQEEWIPFRRVEEGEKEFHVRNPQVHQRVSECLRVLKILQEVTAGQTVFNILPGGLDLMTLKGNIDMSRVAVMGHSFGGATAILALAKETQFRCAVALDAWMFPLERDFYPKARGPVFFINTEKFQTMESVNLMKKICAQHEQSRIITVLGSVHRSQTDFAFVTGNLIGKFFSTETRGSLDPYEGQEVMVRAMLAFLQKHLDLKEDYNQWNNLIEGIGPSLTPGAPHHLSSL

SEQ ID NO: 752094 - protein, 392 aa, Homo sapiens; identical to SEQ ID NO: 752092

SEQ ID NO: 752095 - protein, 392 aa, Homo sapiens; identical to SEQ ID NO: 752092

SEQ ID NO: 752096 - protein, 276 aa, Homo sapiens
ITHFRQQEAERKPASGCCSVFPHPASKFSSGKSFDSPGDEMGVNQSVGFPPVTGPHLVGCGDVMEGQNLQGSFFRLFYPCQKAEETMEQPLWIPRYEYCTGLAEYLQFNKRCGGLLFNLAVGSCRLPVSWNGPFKTKDSGYPLIIFSHGLGAFRTLYSAFCMELASRGFVVAVPEHRDRSAATTYFCKQAPEENQPTNESLQEEWIPFRRVEEGEKEFHVRNPQVHQRVSECLRVLKILQEVTAGQTVFNILPGGLDLMTLKVCGGSGCLDVSSGT

SEQ ID NO: 752097 - protein, 178 aa, Homo sapiens
MCLTFTSLSQGMDYLGSRQYVHRDLAARNVLVESEHQSECAVALDAWMFPLERDFYPKARGPVFFINTEKFQTMESVNLMKKICAQHEQSRIITVLGSVHRSQTDFAFVTGNLIGKFFSTETRGSLDPYEGQEVMVRAMLAFLQKHLDLKEDYNQWNNLIEGIGPSLTPGAPHHLSSL

SEQ ID NO: 752098 - protein, 103 aa, Homo sapiens
MFQLLLFLLHQPGSSHRPWQSYFDLILVDARKPLFFGEGTVLRQVDTKTGKLKIGTYTGPLQHGIVYSGGKSQTSLYLMSLLRPHSESFGNLSAKCHIYCLVV

SEQ ID NO: 752099 - protein, 561 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTDKIMTYLFDFPHGPKPGSSHRPWQSYFDLILVDARKPLFFGEGTVLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 752100 - protein, 561 aa, Homo sapiens; identical to SEQ ID NO: 752099

SEQ ID NO: 752101 - protein, 561 aa, Homo sapiens; identical to SEQ ID NO: 752099

SEQ ID NO: 752102 - protein, 365 aa, Homo sapiens
MFQDVRDAVDWVHYKGSLKEKTVENLEKYVVKDGKLPLLLSRMKEVGKVFLATNSDYKYTDKIMTYLFDFPHGPKPGSSHRPWQSYFDLILVDARKPLFFGEGTVLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 752103 - protein, 536 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTDFDLILVDARKPLFFGEGTVLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 752104 - protein, 569 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGSQVAVQKRPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTDKIMTYLFDFPHGPKPGSSHRPWQSYFDLILVDARKPLFFGEGTVLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 752105 - protein, 510 aa, Homo sapiens
ARGGSLGVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTDKIMTYLFDFPHGPKPGSSHRPWQSYFDLILVDARKPLFFGEGTVLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 752106 - protein, 365 aa, Homo sapiens; identical to SEQ ID NO: 752102

SEQ ID NO: 752107 - protein, 365 aa, Homo sapiens; identical to SEQ ID NO: 752102

SEQ ID NO: 752108 - protein, 268 aa, Homo sapiens
ELRTIRRVLCQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 752109 - protein, 301 aa, Homo sapiens [sequence omitted]

SEQ ID NO: 752110 - protein, 132 aa, Homo sapiens
MDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 752111 - protein, 561 aa, Homo sapiens; identical to SEQ ID NO: 752099

SEQ ID NO: 752112 - protein, 251 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGSQVAVQKRPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDSKSSRIQYFLKVLW

SEQ ID NO: 752113 - protein, 239 aa, Homo sapiens [sequence omitted]

SEQ ID NO: 752114 - protein, 108 aa, Homo sapiens
GAGRMPRDGDPQKGKAGVPSFEDLQTRGTDRRSAVRERRLRRTLRRSWGTEQRAGPWPGASRGAARGGAGRRGRGGRALRRLRQLRAGIVAVRWSRVSLCCPGWSTVM

SEQ ID NO: 752115 - protein, 206 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSEFSASERCHIANLRDGTAPAAPCRLS

SEQ ID NO: 752116 - protein, 561 aa, Homo sapiens; identical to SEQ ID NO: 752099

SEQ ID NO: 752117 - protein, 561 aa, Homo sapiens; identical to SEQ ID NO: 752099

SEQ ID NO: 752118 - protein, 561 aa, Homo sapiens; identical to SEQ ID NO: 752099

SEQ ID NO: 752119 - protein, 561 aa, Homo sapiens; identical to SEQ ID NO: 752099

SEQ ID NO: 752120 - protein, 561 aa, Homo sapiens; identical to SEQ ID NO: 752099

SEQ ID NO: 752121 - protein, 365 aa, Homo sapiens; identical to SEQ ID NO: 752102

SEQ ID NO: 752122 - protein, 365 aa, Homo sapiens; identical to SEQ ID NO: 752102

SEQ ID NO: 752123 - protein, 502 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTDKIMTYLFDFPHGPKPGSSHRPWQSYFDLILVDARKPLFFGEGTVLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKMPHESTVEHTHVDINEMESPLATRNRTSVDFKDTDYKRHQLTRSISEIKPPNLFPLAPQEITHCHDEDDDEEEEEEEE

SEQ ID NO: 752124 - protein, 266 aa, Homo sapiens
MIKYYKIHILHKKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 752125 - protein, 95 aa, Homo sapiens
GDLEDLLLLPLQGLPCLMPHESTVEHTHVDINEMESPLATRNRTSVDFKDTDYKRHQLTRSISEIKPPNLFPLAPQEITHCHDEDDDEEEEEEEE

SEQ ID NO: 752126 - protein, 243 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDSKSSRIQYFLKVLW

SEQ ID NO: 752127 - protein, 287 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTDNNFMTLPVWISHMGPSLGAPIRTMGSPYLT

SEQ ID NO: 752128 - protein, 69 aa, Homo sapiens
VRCNPKLTCVKLYQTSRFSQPVSIPVAHEKTSFPQRLHHEIQSNLIFFKNLFWLGVVVHACNPIIYSGG

SEQ ID NO: 752129 - protein, 108 aa, Homo sapiens; identical to SEQ ID NO: 752114

SEQ ID NO: 752130 - protein, 225 aa, Homo sapiens
MGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQVSPRFYIFNLDPIQKNLTFD

SEQ ID NO: 752131 - protein, 902 aa, Homo sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNDNIEQRKPCDTMKVGGNLDSKGYGVATPKGSSLRTPVNLAVLKLSEAGVLDKLKNKWWYDKGECGPKDSGSKDKTSALSLSNVAGVFYILVGGLGLAMLVALIEFCYKSRAEAKRMKLTFSEAIRNKARLSITGSVGENGRVLTPDCPKAVHTGTAIRQSSGLAVIASDLP

SEQ ID NO: 752132 - protein, 902 aa, Homo sapiens; identical to SEQ ID NO: 752131

SEQ ID NO: 752133 - protein, 732 aa, Homo sapiens
MEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNDNIEQRKPCDTMKVGGNLDSKGYGVATPKGSSLRTPVNLAVLKLSEAGVLDKLKNKWWYDKGECGPKDSGSKDKTSALSLSNVAGVFYILVGGLGLAMLVALIEFCYKSRAEAKRMKLTFSEAIRNKARLSITGSVGENGRVLTPDCPKAVHTGTAIRQSSGLAVIASDLP

SEQ ID NO: 752134 - protein, 78 aa, Homo sapiens
RHRLQCFSEQPLGRVREKERERAPGRGEKKMRIISRQIVLLFSGFWGLAMGAFPSSVQIGKVCSDGVCMWLVVADIRK

SEQ ID NO: 752135 - protein, 107 aa, Homo sapiens
EAEMDYSNWEPDAPSSHFNGVVVVELQRKERPPVRFLPLPGPLYHSKSQGQLAVFTTLLMFFWRHQLNHSHHRSEGAGPSLLPAGSSPSSLPSSLIPPRSWNGPEFQ

SEQ ID NO: 752136 - protein, 430 aa, Homo sapiens
MSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 752137 - protein, 354 aa, Homo sapiens
MSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 752138 - protein, 124 aa, Homo sapiens
RDGRVSPCPGLSLSGTLPVRAEPGGTRLMVGALGRKLCWELEGALDPEVRCGWREWTQTSLFSTTWARRSVCVQFLTSPSPFLPFCLPEDTGPRDAPGEKGNRERGASISYETELFIRLGPVPL

SEQ ID NO: 752139 - protein, 111 aa, Homo sapiens
MYFVFIQLLSSGSAWFAIILMVVTCLFLDIIKKVFDEHLHPTSTEKAQMYSNTVALSDEFIALQPLSRARNQLSKLSLLKQMQVSSAWTPCAVSRKEKQRVHLLEECWNEL

SEQ ID NO: 752140 - protein, 874 aa, Homo sapiens
STILKYTWQAEEKWDEPWYNQKTEHQRNSSKILRFISDFLAFLVLYNFIIPISLYVTVEMQKFLGSFFIGWDLDLYHEESDQKAQVNTSDLNEELGQVEYVFTDKTGTLTENEMQFRECSINGMKYQEINGRLVPEGPTPDSSEGNLSYLSSLSHLNNLSHLTTSSSFRTSPENETELIKEHDLFFKAVSLCHTVQISNVQTDCTGDGPWQSNLAPSQLEYYASSPDEKALVEAAARIGIVFIGNSEETMEVKTLGKLERYKLLHILEFDSDRRRMSVIVQAPSGEKLLFAKGAESSILPKCIGGEIEKTRIHVDEFALKGLRTLCIAYRKFTSKEYEEIDKRIFEARTALQQREEKLAAVFQFIEKDLILLGATAVEDRLQDKVRETIEALRMAGIKVWVLTGDKHETAVSVSLSCGHFHRTMNILELINQKSDSECAEQLRQLARRITEDHVIQHGLVVDGTSLSLALREHEKLFMEVCRNCSAVLCCRMAPLQKAKVIRLIKISPEKPITLAVGDGANDVSMIQEAHVGIGIMGKEGRQAARNSDYAIARFKFLSKLLFVHGHFYYIRIATLVQYFFYKNVCFITPQFLYQFYCLFSQQTLYDSVYLTLYNICFTSLPILIYSLLEQHVDPHVLQNKPTLYRDISKNRLLSIKTFLYWTILGFSHAFIFFFGSYLLIGKDTSLLGNGQMFGNWTFGTLVFTVMVITVTVKMALETHFWTWINHLVTWGSIIFYFVFSLFYGGILWPFLGSQNMYFVFIQLLSSGSAWFAIILMVVTCLFLDIIKKVFDRHLHPTSTEKAQLTETNAGIKCLDSMCCFPEGEAACASVGRMLERVIGRCSPTHISRSWSASDPFYTNDRSILTLSTMDSSTC

SEQ ID NO: 752141 - protein, 874 aa, Homo sapiens; identical to SEQ ID NO: 752140

SEQ ID NO: 752142 - protein, 874 aa, Homo sapiens; identical to SEQ ID NO: 752140

SEQ ID NO: 752143 - protein, 874 aa, Homo sapiens; identical to SEQ ID NO: 752140

SEQ ID NO: 752144 - protein, 874 aa, Homo sapiens; identical to SEQ ID NO: 752140

SEQ ID NO: 752145 - protein, 874 aa, Homo sapiens; identical to SEQ ID NO: 752140

SEQ ID NO: 752146 - protein, 859 aa, Homo sapiens
STILKYTWQAEEKWDEPWYNQKTEHQRNSSKILRFISDFLAFLVLYNFIIPISLYVTVEMQKFLGSFFIGWDLDLYHEESDQKAQVNTSDLNEELGQVEYVFTDKTGTLTENEMQFRECSINGMKYQEINGRLVPEGPTPDSSEGNLSYLSSLSHLNNLSHLTTSSSFRTSPENETELIKEHDLFFKAVSLCHTVQISNVQTDCTGDGPWQSNLAPSQLEYYASSPDEKALVEAAARIGIVFIGNSEETMEVKTLGKLERYKLLHILEFDSDRRRMSVIVQAPSGEKLLFAKGAESSILPKCIGGEIEKTRIHVDEFALKGLRTLCIAYRKFTSKEYEEIDKRIFEARTALQQREEKLAAVFQFIEKDLILLGATAVEDRLQDKVRETIEALRMAGIKVWVLTGDKHETAVSVSLSCGHFHRTMNILELINQKSDSECAEQLRQLARRITEDHVIQHGLVVDGTSLSLALREHEKLFMEVCRNCSAVLCCRMAPLQKAKVIRLIKISPEKPITLAVGDGANDVSMIQEAHVGIGIMGKEGRQAARNSDYAIARFKFLSKLLFVHGHFYYIRIATLVQYFFYKNVCFITPQFLYQFYCLFSQQTLYDSVYLTLYNICFTSLPILIYSLLEQHVDPHVLQNKPTLYRDISKNRLLSIKTFLYWTILGFSHAFIFFFGSYLLIGKDTSLLGNGQMFGNWTFGTLVFTVMVITVTVKMALETHFWTWINHLVTWGSIIFYFVFSLFYGGILWPFLGSQNMYFVFIQLLSSGSAWFAIILMVVTCLFLDIIKKVFDRHLHPTSTEKAQLTETNAGIKCLDSMCCFPEGEAACASVGRMLERVIGRCSPTHISRCEISLSSLCCR

SEQ ID NO: 752147 - protein, 79 aa, Homo sapiens
QNMYFVFIQLLSSGSAWFAIILMVVTCLFLDIIKKVFDEHLHPTSTEKAQMYSNTVALSDEFIALQPLSRARNQLSKLR

SEQ ID NO: 752148 - protein, 537 aa, Homo sapiens
MLARETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 752149 - protein, 542 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 752150 - protein, 542 aa, Homo sapiens; identical to SEQ ID NO: 752149

SEQ ID NO: 752151 - protein, 570 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRGCCWLMLKLLERSPLGKCVAVEANEYDSDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 752152 - protein, 435 aa, Homo sapiens
MPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 752153 - protein, 542 aa, Homo sapiens; identical to SEQ ID NO: 752149

SEQ ID NO: 752154 - protein, 524 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 752155 - protein, 556 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPKTGFHHVGQAGLELLDLMICPPPPSEVLGLQA

SEQ ID NO: 752156 - protein, 275 aa, Homo sapiens
MLARETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRGRYFIHFRMYLIC

SEQ ID NO: 752157 - protein, 280 aa, Homo sapiens [sequence omitted]

SEQ ID NO: 752158 - protein, 667 aa, Homo sapiens
MGSPVDFPAPANREQNPGRGGRFPQAAAGFDPARRPRRRGRRLGLRGWERLRGGGKTGSHGCVPILRFAPPGRERRRRRRRERLNVGSVIERSGRSRASSRGAPLSPSALLSRQSPGRAVPADGRAAETLAEEALPAARTGRRHPRRAPHRHPHPPASRSEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRGCCWLMLKLLERSPLGKCVAVEANEYDSDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 752159 - protein, 542 aa, Homo sapiens; identical to SEQ ID NO: 752149

SEQ ID NO: 752160 - protein, 526 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPSK

SEQ ID NO: 752161 - protein, 565 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTMKCSFEIVIKVNINSNMLFSSYKWDDVEKQSFNV

SEQ ID NO: 752162 - protein, 262 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARVNIFFNTLPKKYLCFGYAV

SEQ ID NO: 752163 - protein, 83 aa, Homo sapiens
MSMAFLTCCLLKCVKKSKRRRSNRSAQLWSQLKDEDLETVQAAYLGLKHFNKPVSGPSQAHDNHSFTTPVCKLGATTRDLLAS

SEQ ID NO: 752164 - protein, 242 aa, Homo sapiens
MKNIGLVMEWEIPEIICTCAKLRLPPQATFQVLRGNGASVGTVLMFRCPSNHQMVGSGLLTCTWKGSIAEWSSGSPVCKLVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHMANPRQPLPASGLATGMPQQPAAYALG

SEQ ID NO: 752165 - protein, 286 aa, Homo sapiens
PPLTQAQAQAPPPQAGLTRLADPAKRLGARRMRWAAATLRGKARPRGRAGVTTPAPGNRTGTCAKLRLPPQATFQVLRGNGASVGTVLMFRCPSNHQMVGSGLLTCTWKGSIAEWSSGSPVCKLVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHMANPRQPLPASGLATGMPQQPAAYALG

SEQ ID NO: 752166 - protein, 286 aa, Homo sapiens; identical to SEQ ID NO: 752165

SEQ ID NO: 752167 - protein, 286 aa, Homo sapiens; identical to SEQ ID NO: 752165

SEQ ID NO: 752168 - protein, 209 aa, Homo sapiens
PPLTQAQAQAPPPQAGLIAWQTPPSASERAGCAGRPPPSVARRGPGGGPGSPRLPQGTAQVRAGAEWPRAGLCAHFTDGKAEGRGSRGRTAVGGGHSNDLPRGRTSSTLRRPSRRPSGAEAWQRAVRNQAAARSSPRARSRVAAAPWSRASADSAAGQASPRRRLRAPPRPSRGSRNRPHLAGGWRGGGRGEPGALSAPEGGVIFTIPW

SEQ ID NO: 752169 - protein, 233 aa, Homo sapiens
MPQCLREGTCAKLRLPPQATFQVLRGNGASVGTVLMFRCPSNHQMVGSGLLTCTWKGSIAEWSSGSPVCKLVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHMANPRQPLPASGLATGMPQQPAAYALG

SEQ ID NO: 752170 - protein, 223 aa, Homo sapiens
PPLTQAQAQAPPPQAGLTRLADPAKRLGARRMRWAAATLRGKARPRGRAGVTTPAPGNRTVVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHMANPRQPLPASGLATGMPQQPAAYALG

SEQ ID NO: 752171 - protein, 286 aa, Homo sapiens; identical to SEQ ID NO: 752165

SEQ ID NO: 752172 - protein, 286 aa, Homo sapiens; identical to SEQ ID NO: 752165

SEQ ID NO: 752173 - protein, 116 aa, Homo sapiens
MESLAQGLVWKETVQYYSRKKEDSHLCLGDKAMYDITQNLKDAPPTKQFLHGILESLERGLNTTSFEKEEKIQKSEVDHVDQDPTPSRLESSPKTDHTFLSTPYIGHKEMLKVIRD

SEQ ID NO: 752174 - protein, 78 aa, Homo sapiens
MFWLSLVQVAGGAGGLCSLPGFGPLDRLHLPLIVAPLAGCLPPQSHAALGTLPLPGTGAGAGAAVFMGVLPVLGTALS

SEQ ID NO: 752175 - protein, 421 aa, Homo sapiens
APRSSRGAQAAACHTSHHSAGSRPGGHLGGQAVGTPNCVPVEGPGCTKEEDVLASSACVSTDGGSLHCHNPSGPSDVPARQPHPEQEGWPPGTGDFPSQVPKQVLDVSQELLQSGVVTLPGTRDRHGRAVVQVRTRSLLWTREHSSCAELTRLLLYFHSIPRKEVRDLGLVVLVDARRSPAAPAVSQALSGLQNNTSPIIHSILLLVDKESAFRPDKDAIIQCEVVSSLKAVHKFVDSCQLTADLDGSFPYSHGDWICFRQRLEHFAANCEEAIIFLQNSFCSLNTHRTPRTAQEVAELIDQHETMMKLVLEDPLLVSLRLEGGTVLARLRREELGTEDSRDTLEAATSLYDRVDEEVHRLVLTSNNRLQQLEHLRELASLLEGNDQVRAAGGRRPGQHPLQARLAKATLSPSHCVFRALI

SEQ ID NO: 752176 - protein, 207 aa, Homo sapiens
APRSSRGAQAAACHTSHHSAGSRPGGHLGGQAVGTPNCVPVEGPGCTKEEDVLASSACVSTDGGSLHCHNPSGPSDVPARQPHPEQEGWPPGTGDFPSQVPKQVLDVSQELLQSGVVTLPGTRDRHGRAVVQVRTRSLLWTREHSSCAELTRLLLYFHSIPRKEVRDLGLVVLVDARRSPAAPAVSQALSGLQVRQGCHIPWVCRAS

SEQ ID NO: 752177 - protein, 355 aa, Homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 752178 - protein, 53 aa, Homo sapiens
IPEGQRFSIIEPGKFACTLDTNMLKQQGMFGHEVEEFGLQVHCNGIPSLLPHG

SEQ ID NO: 752179 - protein, 111 aa, Homo sapiens
FGTIVITYSMKAGIQTEEHPNPGKRYPGIQRTAYLPDNKEGRKVLKLLYRAFDQKLIFTVGYSRVLGVSDVITWNDIHHKTSRFGGPEMYGYPDPSYLKRVKEELKAKGIE

SEQ ID NO: 752180 - protein, 109 aa, Homo sapiens
AGGGWGESAPRFHKIVCLTQVASKPAEGYLPPKSLAEAGVRKPFLESLLLIWKTELLSFIAFSLKRQVLTILPCLSREDIKTGLELLGSSHPPTLASRVDGIIGMCHGA

SEQ ID NO: 752181 - protein, 183 aa, Homo sapiens [sequence omitted]

SEQ ID NO: 752182 - protein, 438 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 752183 - protein, 203 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLGEWLPMGPGGRKTVSEVWNSRVGLSPEPILSLSQR

SEQ ID NO: 752184 - protein, 438 aa, Homo sapiens; identical to SEQ ID NO: 752182

SEQ ID NO: 752185 - protein, 405 aa, Homo sapiens
MDRGEFPFPASRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 752186 - protein, 426 aa, Homo sapiens
MALRGVSVRLLSRGPGLHVLRTWVSSAAQTASRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 752187 - protein, 258 aa, Homo sapiens
MPMAARNSGRSTCPSWPRGSSWAASGSQSPTAEVTPAAWRPEPTTTHPTRATPSMGPRPVWARCEDGCIRGFLLEKGMRGLSAPRIQGKFSLRASATGMIIMDGVEVPEENVLPGASSLGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 752188 - protein, 428 aa, Homo sapiens [sequence omitted]

SEQ ID NO: 752189 - protein, 361 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDK

SEQ ID NO: 752190 - protein, 273 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIFTPACSSAA

SEQ ID NO: 752191 - protein, 446 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGELIHSTAAAETMTPTEPSPDPHPTPSSGSES

SEQ ID NO: 752192 - protein, 278 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSWELLYKVLGVLFFAIACFLYKPLSESSDGLETCLPSQSSAPDSATDSQLQSSVLTTARAHPATAGTQHFLMTEQCRSQ

SEQ ID NO: 752193 - protein, 92 aa, Homo sapiens [sequence omitted]

SEQ ID NO: 752194 - protein, 187 aa, Homo sapiens
MSDRYLEQRISIKFCVKLNKSASETHHLLKEAYGDEVMSRARVFDWHKRFKEGREDVRDDARSGRPVTHRTDDNIQKVKDLVCSNRQLTVRMMAEELNLDKETVRLILKENLNMRKISAKVISGVLKGEPKPRKLDFRSDLSKETRKNSSCLRKKRRNLTMLPRLVSNSLSQGILPPWPPKALGLSA

SEQ ID NO: 752195 - protein, 161 aa, Homo sapiens
MSDRYLEQRISIKFCVKLNKSASETHHLLKEAYGDEVMSRARVFDWHKRFKEGREDVRDDARSGRPVTHRTDDNIQKVKDLVCSNRQLTVRMMAEELNLDKETVRLILKENLNMRKISAKVISGVLKGEPKPRKLDFRSDLSKETRKNSSCLRKKDVFLLY

SEQ ID NO: 752196 - protein, 68 aa, Homo sapiens
GRRNRNEEGEAAEISKLSLQGIVDARWMEVCLSVCQGAGEYFPVCESSITPGVVAPPPRPGQGTRPSR

SEQ ID NO: 752197 - protein, 108 aa, Homo sapiens
HNVSPMLGPSLTPGHPSLARGVPGQLCPWECPTRAGHSQPRWAKGCLSGGKGDGVGSQGQFWTCTMLVTALGFCSQSLNMDAASCATVCHPPWPPFPVPDPSSGGSCD

SEQ ID NO: 752198 - protein, 902 aa, Homo sapiens
GFLEPPPLAGFCLTPLSFPCRLSSADGPGAGMADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 752199 - protein, 215 aa, Homo sapiens
VYAMTVTSFLLPSVEARASVSGQIMSLLIPHRGSLFYYHSSVLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 752200 - protein, 902 aa, Homo sapiens; identical to SEQ ID NO: 752198

SEQ ID NO: 752201 - protein, 134 aa, Homo sapiens
SLLFGLVFAFFHLTTTSCPFWSLGCCWGLPGMLIPRPCLPPPPPASPVSAAASWALSRVLSAQQPPPCWFATQPQGSHPNRAQVGCPRPGRAIGLSSDPGAKGLPGGCAHMLFSLCRLGWGAVAQSRLTATSTS

SEQ ID NO: 752202 - protein, 399 aa, Homo sapiens
MGRKSLYLLIVGILIAYYIYTPLPDNVEEPWRMMWINAHLKTIQNLATFVELLGLHHFMDSFKVVGSFDEVPPTSDENVTVTETKFNNILVRVYVPKRKSEALRRGLFYIHGGGWCVGSAALSGYDLLSRWTADRLDAVVVSTNYRLAPKYHFPIQFEDVYNALRWFLRKKVLAKYGVNPERIGISGDSAGGNLAAAVTQQLLDDPDVKIKLKIQSLIYPALQPLDVDLPSYQENSNFLFLSKSLMVRFWSEYFTTDRSLEKAMLSRQHVPVESSHLFKFINWSSLLPERFIKGHVYNNPNYGSSELAKKYPGFLDVRAAPLLADDNKLRGLPLTYVITCQYDLLRDDGLMYVTRLRNTGVQVTHNHVEDGFHGAFSFLGLKISHRLINQYIEWLKENL

SEQ ID NO: 752203 - protein, 399 aa, Homo sapiens; identical to SEQ ID NO: 752202

SEQ ID NO: 752204 - protein, 381 aa, Homo sapiens
MGRKSLYLLIVGILIAYYIYTPLPDNVEEPWRMMWINAHLKTIQNLATFVELLGLHHFMDSFKVVGSFDEVPPTSDENVTVTETKFNNILVRVYVPKRKSEALRRGLFYIHGGGWCVGSAALSGYDLLSRWTADRLDAVVVSTNYRLAPKYHFPIQFEDVYNALRWFLRNSAGGNLAAAVTQQLLDDPDVKIKLKIQSLIYPALQPLDVDLPSYQENSNFLFLSKSLMVRFWSEYFTTDRSLEKAMLSRQHVPVESSHLFKFINWSSLLPERFIKGHVYNNPNYGSSELAKKYPGFLDVRAAPLLADDNKLRGLPLTYVITCQYDLLRDDGLMYVTRLRNTGVQVTHNHVEDGFHGAFSFLGLKISHRLINQYIEWLKENL

SEQ ID NO: 752205 - protein, 204 aa, Homo sapiens
MGRKSLYLLIVGILIAYYIYTPLPDNVEEPWRMMWINAHLKTIQNLATFVELLGLHHFMDSFKVVGSFDEVPPTSDENVTVTETKFNNILVRVYVPKRKSEALRRGLFYIHGGGWCVGSAALSGYDLLSRWTADRLDAVVVSTNYRLAPKYHFPIQFEDVYNALRWFLRKKVLAKYGVNPERIGISGDSAGGNLAAAVTQQVCS

SEQ ID NO: 752206 - protein, 381 aa, Homo sapiens
MGRKSLYLLIVGILIAYYIYTPLPDNVEEPWRMMWINAHLKTIQNLATFVELLGLHHFMDSFKVVGSFDEVPPTSDENVTVTETLRRGLFYIHGGGWCVGSAALSGYDLLSRWTADRLDAVVVSTNYRLAPKYHFPIQFEDVYNALRWFLRKKVLAKYGVNPERIGISGDSAGGNLAAAVTQQLLDDPDVKIKLKIQSLIYPALQPLDVDLPSYQENSNFLFLSKSLMVRFWSEYFTTDRSLEKAMLSRQHVPVESSHLFKFINWSSLLPERFIKGHVYNNPNYGSSELAKKYPGFLDVRAAPLLADDNKLRGLPLTYVITCQYDLLRDDGLMYVTRLRNTGVQVTHNHVEDGFHGAFSFLGLKISHRLINQYIEWLKENL

SEQ ID NO: 752207 - protein, 67 aa, Homo sapiens
YRRPANEEWTFSYVCLHGASPAPLTGVPLPPVNKTVTDRWTLEAGRCADALILSTVKKNSQSPRTSL

SEQ ID NO: 752208 - protein, 87 aa, Homo sapiens
QLVQGMARQQKAWHPPLLRLPCGWGTLMVGSVYSRPPQKAMQSGPPSPSARLGSSLAGEGLQSWPELSHCQESLNVSTRTTSALVGL

SEQ ID NO: 752209 - protein, 135 aa, Homo sapiens
MLKFLLVSLTAFRREPKHLNLAFSVFQDLKIILIGLKSGICFAFVCRLIALAPGEAVGGYEKEDPDTSTHPAHPRVWSKPSKWLDSQAIRQPVLFALEMKNKGPESGWGLPKVAQQVGSRAGARNHFQLRVQGCS

SEQ ID NO: 752210 - protein, 103 aa, Homo sapiens
MPRPASARARCAHPLTCAHCLALPSEMNPVPQMEMQKSPVFCVAHAGSCRPELIRPSWLLRSLYESNQDGDLTGFYSFIDTHELYQTSGSFSEMFTWKAPGAH

SEQ ID NO: 752211 - protein, 115 aa, Homo sapiens
AVAMFIGVLDLFFIILSYIFILQAVLQLSSQEARYKAFGTCVSHIGAILAFYTPSVISSVMHRVARCAAPHVHILLANFYLLFPPMVNPIIYGVKTKQIRDSLGSIPEKGCVNRE

SEQ ID NO: 752212 - protein, 83 aa, Homo sapiens
STAGLCAGTLTWSGASLGLSPANSLSRVFKLSGYLLVKMSDKPDLSEVEKFDRSKLKKTNTEEKNTLPSKETIQQEKECVQTS

SEQ ID NO: 752213 - protein, 83 aa, Homo sapiens; identical to SEQ ID NO: 752212

SEQ ID NO: 752214 - protein, 460 aa, Homo sapiens
PRTAQAAAFRPPLSPAGGPSPVASRRPSARGDMAGGHSLLLENAQQVVLVCARGERFLARDALRSLAVLEGASLVVGKDGFIKAIGPADVIQRQFSGETFEEIIDCSGKCILPGLVDAHTHPVWAGERVHEFAMKLAGATYMEIHQAGGGIHFTVERTRQATEEELFRSLQQRLQCMMRAGTTLVECKSGYGLDLETELKMLRVIERARRELDIGISATYCGAHSVPKKSGKTATEAADDIINNHLPKLKELGRNGEIHVDNIDVFCEKGVFDLDSTRRILQRGKDIGLQINFHGDELHPMKAAELGAELGAQAISHLEEVSDEGIVAMATARCSAILLPTTAYMLRLKQPRARKMLDEGVIVALGSDFNPNAYCFSMPMVMHLACVNMRMSMPEALAAATINAAYALGKSHTHGSLEVGKQGDLIIINSSRWEHLIYQFGGHHELIEYVIAKGKLIYKT

SEQ ID NO: 752215 - protein, 439 aa, Homo sapiens
PRTAQAAAFRPPLSPAGGPSPVASRRPSARGDMAGGHSLLLENAQQVVLVCARGERFLARDALRSLAVLEGASLVVGKDGFIKAIGPADVIQRQFSGETFEEIIDCSGKCILPGLVDAHTHPVWAGERVHEFAMKLAGATYMEIHQAGGGIHFTVERTRQATEEELFRSLQQRLQCMMRAGTTLVECKSGYGLDLETELKMLRVIERARRELDIGISATYCGAHSVPKKSGKTATEAADDIINNHLPKLKELGRNGEIHVDNIDVFCEKGVFDLDSTRRILQRGLGLNWELQAISHLEEVSDEGIVAMATARCSAILLPTTAYMLRLKQPRARKMLDEGVIVALGSDFNPNAYCFSMPMVMHLACVNMRMSMPEALAAATINAAYALGKSHTHGSLEVGKQGDLIIINSSRWEHLIYQFGGHHELIEYVIAKGKLIYKT

SEQ ID NO: 752216 - protein, 228 aa, Homo sapiens
PRTAQAAAFRPPLSPAGGPSPVASRRPSARGDMAGGHSLLLENAQQVVLVCARGERFLARDALRSLAVLEGASLVVGKDGFIKAIGPADVIQRQFSGETFEEIIDCSGKCILPGLVDAHTHPVWAGERVHEFAMKLAGATYMEIHQAGGGIHFTVERTRQATEEELFRSLQQRLQCMMRAGTTLVECKSGYGLDLETELKMLRVIERARRELDIGISATYCGAHSVPK

SEQ ID NO: 752217 - protein, 460 aa, Homo sapiens; identical to SEQ ID NO: 752214

SEQ ID NO: 752218 - protein, 405 aa, Homo sapiens
PRTAQAAAFRPPLSPAGGPSPVASRRPSARGDMAGGHSLLLENAQQVVLVCARGERFLARDALRSLAVLEGASLVVGKDGFIKAIGPADVIQRQFSGETFEEIIDCSGKCILPGLVDAHTHPVWAGERVHEFAMKLAGATYMEIHQAGGGIHFTVERTRQATEEELFRSLQQRLQCMMRAGTTLVECKSGYGLDLETELKMLRVIERARRELDIGISATYCGAHSVPKKSGKTATEAADDIINNHLPKLKELGRNGEIHVDNIDVFCEKGVFDLDSTRRILQRGKDIGLQINFHGDELHPMKAAELGAELGAQAISHLEEVSDEGIPTTAYMLRLKQPRARKMLDEGVIVALGSDFNPNAYCFSMTHHLYTGTGAFLKWVHFYQLQSCNFFGNFLKFSILYITIG

SEQ ID NO: 752219 - protein, 130 aa, Homo sapiens
QKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHN

SEQ ID NO: 752220 - protein, 103 aa, Homo sapiens
MPGGAQACLFQRNSWGPGACLGAWGIHTLTWAWLRRSLNPHHPGLGGWNHLASSDASPNELGREGRCPIGPSRTPAWKAAAPTPGPGARLQPQVGSQGPATAA

SEQ ID NO: 752221 - protein, 142 aa, Homo sapiens
LAHLAPWLSTAGKSPYQAACCGWFSSPRLPVSWKSYRVPVGQNSQAPCCRQSKTKTPGSRIPCPSLQFGFTKGGAVIPGWRRECWFFVFVFLTCMKLTSSQILFHPPLEAPITHPCYGHHTYARPPPPPQSHSGVCPCCGKE

SEQ ID NO: 752222 - protein, 168 aa, Homo sapiens
SSDDHTHFASLSCPELLRLISAKCTGIFMLRIKDHDRLSGPRKYFPFATQMPSHPSRVQDFSRKKNHLIKGKLCLIPTTRRCNHLPGHSHFFPFFLTPSYVCVVGQGIRGIISLQYKKCVALYRGSQRAFFLLCEDTRGIQQSAIWKITLPEPNHAGTLILNFQPPEL

SEQ ID NO: 752223 - protein, 279 aa, Homo sapiens
MPCRREEEEEAGEEAEGEEEEEDSFLLLQQSVALGSSGEVDRLVAQIGETLQLDAAQHSPASPCGPPGAPLRAPGPLAAAVPADKARSPAVPLLLPPALAETVGPAPPGVLRCALGDRGRVRGRAAPYCVAELATGPSALSPLPPQADLDGPPGAGKQGIPQPLSGPCRRGWLRGAAASRRLQQRRGSQPETRTGDDDPHRLLQQLVLSGNLIKEAVRRLHSRRLQLRAKLPQRPLLGPLSAPVHEPPSPRSPRAACSDPGASGRAQLRTGDGVLVPGS

SEQ ID NO: 752224 - protein, 279 aa, Homo sapiens; identical to SEQ ID NO: 752223

SEQ ID NO: 752225 - protein, 279 aa, Homo sapiens; identical to SEQ ID NO: 752223

SEQ ID NO: 752226 - protein, 106 aa, Homo sapiens
MKLPWIPSLPISRPSVLAVMVTMTLKVGAPPMLFIQRSVVNSPSCSSESRTTVYFWPPSVSPFMTKLDQSLPTRTPTSAGVMLRKVFPGTVAQMEGGSLLPTMAVS

SEQ ID NO: 752227 - protein, 78 aa, Homo sapiens
SGSGLTYKTAKDSFRWATGEHQAFTSFAFGQPDNHGFGNCVELQASAAFNWNDQRCKTRNRYICQFAQEHISRWGPGS

SEQ ID NO: 752228 - protein, 78 aa, Homo sapiens; identical to SEQ ID NO: 752227

SEQ ID NO: 752229 - protein, 61 aa, Homo sapiens
MLRILYNGPEITKEEEACQELLRSKLLQRCQWQVEANGVISPALTPSPSPLPLTIEEDREF

SEQ ID NO: 752230 - protein, 127 aa, Homo sapiens
SLNFKVEGDTVTFSFEMRSGREHNTPDKAMWGLCLHSSRSGVFGGCLRRLALSGRPGFRSVCVSLFHVKNPVQWTRNYQRRRSLSGAIAVQTFTKVPVAGGGQWRDLPCPYSEPLSTASDHRGRQRI

SEQ ID NO: 752231 - protein, 79 aa, Homo sapiens
TRRGRRQHVRFTEYVKDGLKHTCVKFYIEGSEPGKQGTVYAQVKENPGSGEYDFRYIFVEIESYPRRTIIIEDNRSQDD

SEQ ID NO: 752232 - protein, 79 aa, Homo sapiens; identical to SEQ ID NO: 752231

SEQ ID NO: 752233 - protein, 79 aa, Homo sapiens; identical to SEQ ID NO: 752231

SEQ ID NO: 752234 - protein, 79 aa, Homo sapiens; identical to SEQ ID NO: 752231

SEQ ID NO: 752235 - protein, 355 aa, Homo sapiens
IVFLLYLETCLEVMDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGLSEPQFVQFNGGFSQEQLNWLNEVLTFSDTNQEKVVIVSHLPIYPDASDNVCLAWNYRDALAVIWSHECVVCFFAGHTHDGGYSEDPFGVYHVNLEGVIETAPDSQAFGTVHVYPDKMMLKGRGRVPDRIMNYKKERAFHC

SEQ ID NO: 752236 - protein, 205 aa, Homo sapiens
MDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGELFL

SEQ ID NO: 752237 - protein, 205 aa, Homo sapiens; identical to SEQ ID NO: 752236

SEQ ID NO: 752238 - protein, 205 aa, Homo sapiens; identical to SEQ ID NO: 752236

SEQ ID NO: 752239 - protein, 205 aa, Homo sapiens; identical to SEQ ID NO: 752236

SEQ ID NO: 752240 - protein, 331 aa, Homo sapiens
IVFLLYLETCLEVMDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGLSEPQFVQFNGGFSQEQLNWLNEVLTFSDTNQEKVVIVSHLPIYPDASDNVCLAWNYRDALAVIWSHECVVCFFAGHTHDGGYSEDPFGVSFSTFTALLKSLFLVFSFYHFLAIFTF

SEQ ID NO: 752241 - protein, 198 aa, Homo sapiens
GCRGAEGWGGCRGCRALVQAPPRSLAAGPGDRVPGRRRQPRGPQRGGGGPWRREDSAARGTPGQAPGSPRLGLCGPTALGGDGGAGAYARGQPGETEAVNGPGPALVIPEPGRERPVSRDRSRRSLNSSPPSRMRSAALPSCPCHRCFPTPGRRRDGQTARPVPEACEREARGALRSRERGAGAGDRQRRGRRRGEDK

SEQ ID NO: 752242 - protein, 127 aa, Homo sapiens
MFQAAGAAQATPSHDAKGGGSSTVQRSKSFSLRAQVKETCAACQKTVYPMERLVADKLIFHNSCFCCKHCHTKLSLGSYAALHGEFYCKPHFQQLFKSKGNYDEGFGRKQHKELWAHKEVDPGTKTA

SEQ ID NO: 752243 - protein, 127 aa, Homo sapiens; identical to SEQ ID NO: 752242

SEQ ID NO: 752244 - protein, 127 aa, Homo sapiens; identical to SEQ ID NO: 752242

SEQ ID NO: 752245 - protein, 127 aa, Homo sapiens; identical to SEQ ID NO: 752242

SEQ ID NO: 752246 - protein, 127 aa, Homo sapiens; identical to SEQ ID NO: 752242

SEQ ID NO: 752247 - protein, 127 aa, Homo sapiens; identical to SEQ ID NO: 752242

SEQ ID NO: 752248 - protein, 127 aa, Homo sapiens; identical to SEQ ID NO: 752242

SEQ ID NO: 752249 - protein, 259 aa, Homo sapiens
GGGGGGSGSTGSGSSSRPRPPRTRAPPETDPAPRPRPGLVRAAGGGAASGSGTGRGAEGCGVRAARGVPASLRAALARGAQARVLVSGPAPGWAEPRPAGGARGVGVWGPVLAGPEPSGCRFSTRGFHLQRAMFQAAGAAQATPSHDAKGGGSSTVQRSKSFSLRAQVKETCAACQKTVYPMERLVADKLIFHNSCFCCKHCHTKLSLGSYAALHGEFYCKPHFQQLFKSKGNYDEGFGRKQHKELWAHKEVDPGTKTA

SEQ ID NO: 752250 - protein, 127 aa, Homo sapiens; identical to SEQ ID NO: 752242

SEQ ID NO: 752251 - protein, 157 aa, Homo sapiens
MFQAAGAAQATPSHDAKGGGSSTVQRSKVGAWGRVCGRRGVRERDEQLGQHLAELPAQSFSLRAQVKETCAACQKTVYPMERLVADKLIFHNSCFCCKHCHTKLSLGSYAALHGEFYCKPHFQQLFKSKGNYDEGFGRKQHKELWAHKEVDPGTKTA

SEQ ID NO: 752252 - protein, 285 aa, Homo sapiens
GGGGGGSGSTGSGSSSRPRPPRTRAPPETDPAPRPRPGLNPAGAASPPEASTSNEPCSRLQEPPRPPPLMTPKAAAAARCSAPSTVTPSSAWAATPRCTGSSTANPTSSSCLRAKATTTRGLAASSTRSSGPTRRWTPAPRRPEASVTFHPLCGRPGAGRGKVGRRSSWACVGARWEGDEACSGVGDQGRALLQDSFLLPSPAAGEGLETRIGVCPPPCFLLRSASLPTSPQDPLGGPQAQLPYLGAFSPARSQHAPLRVPSSLTATGDCVAPTSPHLPLPLTCF

SEQ ID NO: 752253 - protein, 105 aa, Homo sapiens
MEPWGWLAQICMRDEGQSSLLTLRLNGQGLRRNHILCCRSRRDSMCLRNVREKGDVSSMDPLQATWIPPYLCRTLLTASWNCQPKGSKLGSRSLKMRGDGWAWWL

SEQ ID NO: 752254 - protein, 682 aa, Homo sapiens
QTIEMWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGATTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 752255 - protein, 550 aa, Homo sapiens
QTIEMWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGATTMTSVGHQSMTPGEKALTPVGHQSVTTGQKTLTSVGYQSVTPGEKTLTPVGHQFCEPWRNDYDPCPFSD

SEQ ID NO: 752256 - protein, 51 aa, Homo sapiens
MLDVGFLVPPLCIGRSRLWSQRLVRSPPHCRIRRTSPLSFLQIVLSLNLCF

SEQ ID NO: 752257 - protein, 51 aa, Homo sapiens; identical to SEQ ID NO: 752256

SEQ ID NO: 752258 - protein, 60 aa, Homo sapiens
TELCQGYAAGIPIKPRVLSRQSPWGLGSGVWAQYRSLVWHSEIGLDSCPPRGTQQAEGAS

SEQ ID NO: 752259 - protein, 436 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLDMQVSSWESQGDLGSSQESSLPLPLDSSSVRILSLVGGMSFSCLLQSTCLAWSFTSRLDKQNFKTGPKRGPLPASEDIKLQT

SEQ ID NO: 752260 - protein, 383 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLGLLLPSICAVALPFVASSYVITIILLILI

SEQ ID NO: 752261 - protein, 446 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLDMQVSSWESQGDLGSSQESSLPLPLDSSSVRLGQFIEHLQVAGIVLGVGDTHGALKIWMATQLLYLHEPLNQTLVGQISQRKKNISLFSQDE

SEQ ID NO: 752262 - protein, 470 aa, Homo sapiens
MGRSLGSAASGARVSCTPVILSCRTHSSSKPPSCTKTRLIRRQVPSFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 752263 - protein, 187 aa, Homo sapiens
SRGHGMTPPPPGRAAPSAPRARVPGPPARLGLPLRLRLLLLLWAAAASAQGHLRSGPRIFAVWKGHVGQDRVDFGQTEPHTVLFHEPGSSSVWVGGRGKVYLFDFPEGKNASVRTVNIGSTKGSCLDKRDCENYITLLERRSEGLLACGTNARLPQLLEPGEWHCGATWRDERLRPLQPGRELPGSV

SEQ ID NO: 752264 - protein, 470 aa, Homo sapiens; identical to SEQ ID NO: 752262

SEQ ID NO: 752265 - protein, 542 aa, Homo sapiens
MNHSVRRLDPVGLVSCVVCRLHLSTSAWYRAHVRDHALGYIMCYNPCQPGRVTPWYCLKGTRCIPPSGSRNTMGRSLGSAASGARVSCTPVILSCRTHSSSKPPSCTKTRLIRRQVPSFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 752266 - protein, 573 aa, Homo sapiens
MGRSLGSAASGARVSCTPVILSCRTHSSSKPPSCTKTRLIRRQVPSFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPGTCSGPAGGCGPMSGVLPCPDCPGLRETWPCPVGPRYMGQDTVLQREPSWWDERDGRKKEDAEGWVPHVHSEALSWDPSPWGGHILPWELFVPPHGCFPTASPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 752267 - protein, 470 aa, Homo sapiens; identical to SEQ ID NO: 752262

SEQ ID NO: 752268 - protein, 104 aa, Homo sapiens
MAAGPGRPQGLGWAAGGGRFFVLPSHLPELTSRTPGSRGHRARGGDPADRAAGGAHCKCRNWPQTLRSWTAPAAPGAAAELVDIFQGGKKSFKCHLFTLKMLIT

SEQ ID NO: 752269 - protein, 104 aa, Homo sapiens; identical to SEQ ID NO: 752268

SEQ ID NO: 752270 - protein, 109 aa, Homo sapiens
MLKLILPSTPPQHQGPWPKPFPGSPSSSHEASFPAPQNSLLYESGQDPTETFPINFIKLIRGEGRGEMEISPACSTHSIGHEVSCSLTHLLRVVCCLLLQSHIDPVTRS

SEQ ID NO: 752271 - protein, 173 aa, Homo sapiens
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 752272 - protein, 173 aa, Homo sapiens; identical to SEQ ID NO: 752271

SEQ ID NO: 752273 - protein, 163 aa, Homo sapiens
MSLLGPKVLLFLAAFIITSDWIPLGVNSQRGDDVTQATPETFTEDPNLVNDPATDETVLAVLADIAPSTDDLECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 752274 - protein, 173 aa, Homo sapiens; identical to SEQ ID NO: 752271

SEQ ID NO: 752275 - protein, 163 aa, Homo sapiens; identical to SEQ ID NO: 752273

SEQ ID NO: 752276 - protein, 173 aa, Homo sapiens; identical to SEQ ID NO: 752271

SEQ ID NO: 752277 - protein, 173 aa, Homo sapiens; identical to SEQ ID NO: 752271

SEQ ID NO: 752278 - protein, 173 aa, Homo sapiens; identical to SEQ ID NO: 752271

SEQ ID NO: 752279 - protein, 243 aa, Homo sapiens
VGQKSGYSCLHARLVRARRLRRAVAVMAAQCVRLARRSLPALALSLRPSPRLLCTATKQKNSGQNLEEDMGQSEQKADPPATEKTLLEEKVKLEEQLKETVEKYKRALADTENLRQRSQKLVEEAKLYGIQAFCKDLLEVADVLEKATQCVPKEEIKDDNPHLKNLYEGLVMTEVQIQKVFTKHGLLKLNPVGAKFDPYEHEALFHTPVEGKEPGTVALVSKVGYKLHGRTLRPALVGVVKEA

SEQ ID NO: 752280 - protein, 243 aa, Homo sapiens; identical to SEQ ID NO: 752279

SEQ ID NO: 752281 - protein, 243 aa, Homo sapiens; identical to SEQ ID NO: 752279

SEQ ID NO: 752282 - protein, 96 aa, Homo sapiens
VGQKSGYSCLHARLVRARRLRRAVAVMAAQCVRLARRSLPALALSLRPSPRLLCTATKQKNSGQNLYEGLVMTEVQIQKVFTNLAAVDGVGVFKLT

SEQ ID NO: 752283 - protein, 243 aa, Homo sapiens; identical to SEQ ID NO: 752279

SEQ ID NO: 752284 - protein, 243 aa, Homo sapiens; identical to SEQ ID NO: 752279

SEQ ID NO: 752285 - protein, 1072 aa, Homo sapiens
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQVRCIPNIFKYPREG

SEQ ID NO: 752286 - protein, 147 aa, Homo sapiens
APLSSWQDAWKKSAVKASPLTTDSRPLPDVALTGKCTRECDEYGHSDSCWMPVRTSPERKKSQPKLSTFMPVDERGSQEKLANGEAAIMGDRNRNLLNKKLTSSYETFSAASFSKNEEANPEDIPLTKTGEYKPSPVNTLTRREVYL

SEQ ID NO: 752287 - protein, 1200 aa, Homo sapiens
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQPFRRVTFSVVSQPQDPHQGSLQSCYDSGLEESETPSSKSSSGPRLGALPLPEDNYERTTPDGSVDSRPLPDVALTGKCTRECDEYGHSDSCWMPVRTSPERKKSQPKLSTFMPVDERGSQEKLANGEAAIMGDRNRNLLNKKLTSSYETFSAASFSKNEEANPEDIPLTKTGEYKPSPVNTLTRREVYL

SEQ ID NO: 752288 - protein, 1069 aa, Homo sapiens
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQMRLHPYITVFG

SEQ ID NO: 752289 - protein, 1247 aa, Homo sapiens
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQPFRRVTFSVVSQPQDPHQGSLQSCYDSGLEESETPSSKSSSGPRLGALPLPEDNYERTTPDGSVDSRPLPDVALTGKCTRECDEYGHSDSCWMPVRTSPERKKSQPKLSTFMPVDERGSQEKLANGEAAIMGDRNRNLLNKKLTSSYETFSAASFSKNEEANPEDIPLTKTGEYKPSPVNTLTRREVYL

SEQ ID NO: 752290 - protein, 72 aa, Homo sapiens
MQVSLTQKSILILFNFSISASLRDTVDYVNWNKAELRLGAVVVHACNPNALGGPEFEISLGKTVRPPSLQKT

SEQ ID NO: 752291 - protein, 1149 aa, Homo sapiens
MEFDGNFNTNVSRTISCDRLSTTVNSRAFNPGRDLNSGVENWLQYLQVLADNLKSNPGIKWQYFSSEEGIFTVFPAHKFRCKGSYEHRSRPIYVSTVRPQSKHIVVILDHGASVTDTQLQIAKDAAQVILSAIDEHDKISVLTVADTVRTCSLDQCYKTFLSPATSETKRKMSTFVSSVKSSDSPTQHAVGFQKAFQLIRSTNNNTKFQANTDMVIIYLSAGITSKDSSEEDKKATLQVINEENSFLNNSVMILTYALMNDGVTGLKELAFLRDLAEQNSGKYGVPDRTALPVIKGSMMVLNQLSNLETTVGRFYTNLPNRMIDEAVFSLPFSDEMGDGLIMTVSKPCYFGNLLLGIVGVDVNLAYILEDVTYYQDSLASYTFLIDDKGYTLMHPSLTRPYLLSEPPLHTDIIHYENIPKFELVRQNILSLPLGSQIIAVPVNSSLSWHINKLRETGKEAYNVSYAWKMVQDTSFILCIVVIQPEIPVKQLKNLNTVPSSKLLYHRLDLLGQPSACLHFKQLATLESPTIMLSAGSFSSPYEHLSQPETKRMVEHYTAYLSDNTRLIANPGLKFSVRNEVMATSHVTDEWMTQMEMSSLNTYIVRRYIATPNGVLRIYPGSLMDKAFDPTRRQWYLHAVANPGLISLTGPYLDVGGAGYVVTISHTIHSSSTQLSSGHTVAVMGIDFTLRYFYKVLMDLLPVCNQDGGNKIRCFIMEDRGYLVAHPTLIDPKGHAPVEQQHITHKEPLVANDILNHPNFVKKNLCNSFSDRTVQRFYKFNTSLAGDLTNLVHGSHCSKYRLARIPGTNAFVGIVNETCDSLAFCACSMVDRLCLNCHRMEQNECECPCECPLEVNECTGNLTNAENRNPSCEVHQEPVTYTAIDPGLQDALHQCVNSRCSQRLESGDCFGVLDCEWCMVDSDGKTHLDKPYCAPQKECFGGIVGAKSPYVDDMGAIGDEVITLNMIKSAPVGPVAGGIMGCIMVLVLAVYAYRHQIHRRSHQHMSPLAAQEMSVRMSNLENDRDERDDDSHEDRGIISNTRFIAAVIERHAHSPERRRRYWGRSGTESDHGYSTMSPQEDSENPPCNNDPLSAGVDVGNHDEDLDLDTPPQTAALLSHKFHHYRSHHPTLHHSHHLQAAVTVHTVDAEC

SEQ ID NO: 752292 - protein, 1258 aa, Homo sapiens
RPPLWLLCLVACWLLGAGAEADFSILDEAQVLASQMRRLAAEELGVVTMQRIFNSFVYTEKISNGESEVQQLAKKIREKFNRYLDVVNRNKQVVEASYTAHLTSPLTAIQDCCTIPPSMMEFDGNFNTNVSRTISCDRLSTTVNSRAFNPGRDLNSVLADNLKSNPGIKWQYFSSEEGIFTVFPAHKFRCKGSYEHRSRPIYVSTVRPQSKHIVVILDHGASVTDTQLQIAKDAAQVILSAIDEHDKISVLTVADTVRTCSLDQCYKTFLSPATSETKRKMSTFVSSVKSSDSPTQHAVGFQKAFQLIRSTNNNTKFQANTDMVIIYLSAGITSKDSSEEDKKATLQVINEENSFLNNSVMILTYALMNDGVTGLKELAFLRDLAEQNSGKYGVPDRTALPVIKGSMMVLNQLSNLETTVGRFYTNLPNRMIDEAVFSLPFSDEMGDGLIMTVSKPCYFGNLLLGIVGVDVNLAYILEDVTYYQDSLASYTFLIDDKGYTLMHPSLTRPYLLSEPPLHTDIIHYENIPKFELVRQNILSLPLGSQIIAVPVNSSLSWHINKLRETGKEAYNVSYAWKMVQDTSFILCIVVIQPEIPVKQLKNLNTVPSSKLLYHRLDLLGQPSACLHFKQLATLESPTIMLSAGSFSSPYEHLSQPETKRMVEHYTAYLSDNTRLIANPGLKFSVRNEVMATSHVTDEWMTQMEMSSLNTYIVRRYIATPNGVLRIYPGSLMDKAFDPTRRQWYLHAVANPGLISLTGPYLDVGGAGYVVTISHTIHSSSTQLSSGHTVAVMGIDFTLRYFYKVLMDLLPVCNQDGGNKIRCFIMEDRGYLVAHPTLIDPKGHAPVEQQHITHKEPLVANDILNHPNFVKKNLCNSFSDRTVQRFYKFNTSLAGDLTNLVHGSHCSKYRLARIPGTNAFVGIVNETCDSLAFCACSMVDRLCLNCHRMEQNECECPCECPLEVNECTGNLTNAENRNPSCEVHQEPVTYTAIDPGLQDALHQCVNSRCSQRLESGDCFGVLDCEWCMVDSDGKTHLDKPYCAPQKECFGGIVGAKSPYVDDMGAIGDEVITLNMIKSAPVGPVAGGIMGCIMVLVLAVYAYRHQIHRRSHQHMSPLAAQEMSVRMSNLENDRDERDDDSHEDRGIISNTRFIAAVIERHAHSPERRRRYWGRSGTESDHGYSTMSPQEDSENPPCNNDPLSAGVDVGNHDEDLDLDTPPQTAALLSHKFHHYRSHHPTLHHSHHLQAAVTVHTVDAEC

SEQ ID NO: 752293 - protein, 556 aa, Homo sapiens
RPPLWLLCLVACWLLGAGAEADFSILDEAQVLASQMRRLAAEELGVVTMQRIFNSFVYTEKISNGESEVQQLAKKIREKFNRYLDVVNRNKQVVEASYTAHLTSPLTAIQDCCTIPPSMMEFDGNFNTNVSRTISCDRLSTTVNSRAFNPGRDLNSVLADNLKSNPGIKWQYFSSEEGIFTVFPAHKFRCKGSYEHRSRPIYVSTVRPQSKHIVVILDHGASVTDTQLQIAKDAAQVILSAIDEHDKISVLTVADTVRTCSLDQCYKTFLSPATSETKRKMSTFVSSVKSSDSPTQHAVGFQKAFQLIRSTNNNTKFQANTDMVIIYLSAGITSKDSSEEDKKATLQVINEENSFLNNSVMILTYALMNDGVTGLKELAFLRDLAEQNSGKYGVPDRTALPVIKGSMMVLNQLSNLETTVGRFYTNLPNRMIDEAVFSLPFSDEMGDGLIMTVSKPCYFGNLLLGIVGVDVNLAYILEDVTYYQDSLASYTFLIDDKGYTLMHPSLTRPYLLSEPPLHTDIIHYENIPKFELVRQNILRIKSGYYNMGHCNFKVVF

SEQ ID NO: 752294 - protein, 1907 aa, Homo sapiens
MEVAWLVYVLGQQPLARQGEGQSRLVPGRGLVLWLPGLPRSSPSWPAVDLAPLAPARPRGPLICHTGHEQAGREPGPGSSTKGPVLHDQDTRCAFLPRPPGPLQTRRYCRHQGRQGSGLGAGPGAGTWAPAPPGVSKPRCPGRARPGEGQQQVTTARPPAINRGARQPRAGAAAAGRGPGAGAWRTGEAAASAGPAVGEGGAMGSRRAPSRGWGAGGRSGAGGDGEDDGPVWIPSPASRSYLLSVRPETSLSSNRLSHPSSGRSTFCSIIAQLTEETQPLFETTLKSRSVSEDSDVRFTCIVTGYPEPEVTWYKDDTELDRYCGLPKYEITHQGNRHTLQLYRCREEDAAIYQASAQNSKGIVSCSGVLEVGTMTEYKIHQRWFAKLKRKAAAKLREIEQSWKHEKAVPGEVDTLRKLSPDRFQRKRRLSGAQAPGPSVPTREPEGGTLAAWQEGETETAQHSGLGLINSFASGEVTTNGEAAPENGEDGEHGLLTYICDAMELGPQRALKEESGAKKKKKDEESKQGLRKPELEKAAQSRRSSENCIPSSDEPDSCGTQGPVGVEQVQTQPRGRAARGPGSSGTDSTRKPASAVGTPDKAQKAPGPGPGQEVYFSLKDMYLENTQAVRPLGEEGPQTLSVRAPGESPKGKAPLRARSEGVPGAPGQPTHSLTPQPTRPFNRKRFAPPKPKGEATTDSKPISSLSQAPECGAQSLGKAPPQASVQVPTPPARRRHGTRDSTLQGQAGHRTPGEVLECQTTTAPTMSASSSSDVASIGVSTSGSQGIIEPMDMETQEDGRTSANQRTGSKKNVQADGKIQVDGRTRGDGTQTAQRTRADRKTQVDAGTQESKRPQSDRSAQKGMMTQGRAETQLETTQAGEKIQEDRKAQADKGTQEDRRMQGEKGMQGEKGTQSEGSAPTAMEGQSEQEVATSLGPPSRTPKLPPTAGPRAPLNIECFVQTPEGSCFPKKPGCLPRSEEAVVTASRNHEQTVLGPLSGNLMLPAQPPHEGSVEQVGGERCRGPQSSGPVEAKQEDSPFQCPKEERPGGVPCMDQGGCPLAGLSQEVPTMPSLPGTGLTASPKAGPCSTPTSQHGSTATFLPSEDQVLMSSAPTLHLGLGTPTQSHPPETMATSSEGACAQVPDVEGRTPGPRSCDPGLIDSLKNYLLLLLKLSSTETSGAGGESQVGAATGGLVPSATLTPTVEVAGLSPRTSRRILERVENNHLVQSAQTLLLSPCTSRRLTGLLDREVQAGRQALAAARGSWGPGPSSLTVPAIVVDEEDPGLASEGASEGEGEVSLEGPGLLGASQESSMAGRLGEAGGQAAPGQGPSAESIAQEPSQEEKFPGEALTGLPAATPEELALGARRKRFLPKVRAAGDGEATTPEERESPTVSPRGPRKSLVPGSPGTPGRERRSPTQGRKASMLEVPRAEEELAAGDLGPSPKAGGLDTEVALDEGKQETLAKPRKAKDLLKAPQVIRKIRVEQFPDASGSLKLWCQFFNILSDSVLTWAKDQRPVGEVGRSAGDEGPAALAIVQASPVDCGVYRCTIHNEHGSASTDFCLSPEVLSGFISREEGEVGEEIEMTPMVFAKGLADSGCWGDKLFGRLVSEELRGGGYGCGLRKASQAKVIYGLEPIFESGRTCIIKVSSLLVFGPSSETSLVGRNYDVTIQGCKIQNMSREYCKIFAAEARAAPGFGEVPEIIPLYLIYRPANNIPYATLEEDLGKPLESYCSREWGCAEAPTASGSSEAMQKCQTFQHWLYQWTNGSFLVTDLAGVDWKMTDVQIATKLRGYQGLKESCFPALLDRFASSHQCNAYCELLGLTPLKGPEAAHPQAKAKGSKSPSAGRKGSQLSPQPQKKGLPSPQGTRKSAPSSKATPQASEPVTTQLLGQPPTQEEGSKAQGMR

SEQ ID NO: 752295 - protein, 1907 aa, Homo sapiens; identical to SEQ ID NO: 752294

SEQ ID NO: 752296 - protein, 1907 aa, Homo sapiens; identical to SEQ ID NO: 752294

SEQ ID NO: 752297 - protein, 1907 aa, Homo sapiens; identical to SEQ ID NO: 752294

SEQ ID NO: 752298 - protein, 990 aa, Homo sapiens
MEVAWLVYVLGQQPLARQGEGQSRLVPGRGLVLWLPGLPRSSPSWPAVDLAPLAPARPRGPLICHTGHEQAGREPGPGSSTKGPVLHDQDTRCAFLPRPPGPLQTRRYCRHQGRQGSGLGAGPGAGTWAPAPPGVSKPRCPGRARPGEGQQQVTTARPPAINRGARQPRAGAAAAGRGPGAGAWRTGEAAASAGPAVGEGGAMGSRRAPSRGWGAGGRSGAGGDGEDDGPVWIPSPASRSYLLSVRPETSLSSNRLSHPSSGRSTFCSIIAQLTEETQPLFETTLKSRSVSEDSDVRFTCIVTGYPEPEVTWYKDDTELDRYCGLPKYEITHQGNRHTLQLYRCREEDAAIYQASAQNSKGIVSCSGVLEVGTMTEYKIHQRWFAKLKRKAAAKLREIEQSWKHEKAVPGEVDTLRKLSPDRFQRKRRLSGAQAPGPSVPTREPEGGTLAAWQEGETETAQHSGLGLINSFASGEVTTNGEAAPENGEDGEHGLLTYICDAMELGPQRALKEESGAKKKKKDEESKQGLRKPELEKAAQSRRSSENCIPSSDEPDSCGTQGPVGVEQVQTQPRGRAARGPGSSGTDSTRKPASAVGTPDKAQKAPGPGPGQEVYFSLKDMYLENTQAVRPLGEEGPQTLSVRAPGESPKGKAPLRARSEGVPGAPGQPTHSLTPQPTRPFNRKRFAPPKPKGEATTDSKPISSLSQAPECGAQSLGKAPPQASVQVPTPPARRRHGTRDSTLQGQAGHRTPGEVLECQTTTAPTMSASSSSDVASIGVSTSGSQGIIEPMDMETQEDGRTSANQRTGSKKNVQADGKIQVDGRTRGDGTQTAQRTRADRKTQVDAGTQESKRPQSDRSAQKGMMTQGRAETQLETTQAGEKIQEDRKAQADKGTQEDRRMQGEKGMQGEKGTQSEGSAPTAMEGQSEQEVATSLGPPSRTPKLPPTAGPRAPLNIECFVQTPEGSCFPKKPGCLPSVSPPLPACIPRLLW

SEQ ID NO: 752299 - protein, 1907 aa, Homo sapiens; identical to SEQ ID NO: 752294

SEQ ID NO: 752300 - protein, 93 aa, Homo sapiens
LFGRLVSEELRGGGYGCGLRKASQAKVIYGLEPIFESGRTCIIKVSSLLVFGPSSETSLVGRNYDVTIQVLCPIFTPHSFILSPPPLSQPRSC

SEQ ID NO: 752301 - protein, 294 aa, Homo sapiens
MAHGIPSQGKVTITVDEYSSNPTQAFTHYNINQSRFQPPHVHMVDPIPYDTPKPAGHTRFVCISDTHSRTDGIQMPYGDILLHTGDFTELGLPSEVKKFNDWLGNLPYEYKIVIAGNHELTFDKEFMADLVKQDYYRFPSVSKLKPEDFDNVQSLLTNSIYLQDSEVTVKGFRIYGAPWTPWFNGWGFNLPRGQSLLDKWNLIPEGIDILMTHGPPLGFRDWVPKELQRVGCVELLNTVQRRVRPKLHVFGGIHEGYGIMTDGYTTYINASTCTVSFQPTNPPIIFDLPNPQGS

SEQ ID NO: 752302 - protein, 294 aa, Homo sapiens; identical to SEQ ID NO: 752301

SEQ ID NO: 752303 - protein, 294 aa, Homo sapiens; identical to SEQ ID NO: 752301

SEQ ID NO: 752304 - protein, 294 aa, Homo sapiens; identical to SEQ ID NO: 752301

SEQ ID NO: 752305 - protein, 168 aa, Homo sapiens
MADLVKQDYYRFPSVSKLKPEDFDNVQSLLTNSIYLQDSEVTVKGFRIYGAPWTPWFNGWGFNLPRGQSLLDKWNLIPEGIDILMTHGPPLGFRDWVPKELQRVGCVELLNTVQRRVRPKLHVFGGIHEGYGIMTDGYTTYINASTCTVSFQPTNPPIIFDLPNPQGS

SEQ ID NO: 752306 - protein, 119 aa, Homo sapiens
RRGARTERRLGRPASWSCAPLTPVAVPVTAPLALPPARRALAPSPRPLARSLPRSRLLGSFLPPPPSSAAPPGPQPQPAAGPPGSKVLARSRPSPPPRAPSAPPAGSGRSAMDRLLAGR

SEQ ID NO: 752307 - protein, 179 aa, Homo sapiens
MAHGIPSQGKVTITVDEYSSNPTQAFTHYNINQSRFQPPHVHMVDPIPYDTPKPAGHTRFVCISDTHSRTDGIQMPYGDILLHTGDFTELGLPSEVKKFNDWLGNLPYEYKIVIAGNHELTFDKEFMADLVKQDYYRFPSVSKLKPEDFDNVQSLLTNSIYLQDSEVTVKGFRIYGAPW

SEQ ID NO: 752308 - protein, 284 aa, Homo sapiens
GCLGGAGCLGGGAAGPAGCSALPAALPMVVPTQPARRLQPRKSSFPGDGDEAPGPGGGEGAAAGGGGGGLGSGGRSAQRRAGAGARRPIGAAPSVGPGGELQGWGRKSGCRPPGPEGWAGGRKLRRWLPPRRFSNFCCRSPCAQTAVRRRRRRAPSPRGAGWREGAGAGRGTPATMAGGEWAAEPLHLPQRGRPAPLHLPEREATEARPRRRRARRRLRVLEPHPPARLGRGIGRVWVKGITAWGLEGHIFSAPRISATASTARRPTVVQRWGARAAFPSRVPD

SEQ ID NO: 752309 - protein, 284 aa, Homo sapiens; identical to SEQ ID NO: 752308

SEQ ID NO: 752310 - protein, 284 aa, Homo sapiens; identical to SEQ ID NO: 752308

SEQ ID NO: 752311 - protein, 58 aa, Homo sapiens
MAAGLAARTTASRQFLRGASPGLSGQLCTRNPEYFPGCSGKTGGSSAESPLGVCVGGA

SEQ ID NO: 752312 - protein, 544 aa, Homo sapiens
MLNMQGAEERDIRRETCPGWVNKNKPALEQDVCKIDSSGIVVKRFQEDEYQDSTFEEKYACEGMKENSPREIAESCLFQEGGFGRITFIHKEAPPEIISQGYNFEKSLLLTSSLVTRLRVSTEESLHQWETSNIQTNDISDQSKCPTLCTQKKSWKCNECGKTFTQSSSLTQHQRTHTGERPYTCEECGKAFSRSSFLVQHQRIHTGVKPYGCEQCGKTFRCRSFLTQHQRIHTGEKPYKCNECGNSFRNHSHLTEHQRIHTGEKPYKCNRCGKAFNQNTHLIHHQRIHTGEKPYICSECGSSFRKHSNLTQHQRIHTGEKPHKCDECGKTFQTKANLSQHQRIHSGEKPYKCKECGKAFCQSPSLIKHQRIHTGEKPYKCKECGKAFTQSTPLTKHQRIHTGERPYKCSECGKAFIQSICLIRHQRSHTGEKPYKCNECGKGFNQNTCLTQHMRIHTGEKPYKCKECGKAFAHSSSLTEHHRTHTGEKLYKCSECEKTFRKYAHLSEHYRIHTGEKPYECIECGKFFRHSSVLFRHQKLHSGD

SEQ ID NO: 752313 - protein, 541 aa, Homo sapiens
MQGAEERDIRRETCPGWVNKNKPALEQDVCKIDSSGIVVKRFQEDEYQDSTFEEKYACEGMKENSPREIAESCLFQEGGFGRITFIHKEAPPEIISQGYNFEKSLLLTSSLVTRLRVSTEESLHQWETSNIQTNDISDQSKCPTLCTQKKSWKCNECGKTFTQSSSLTQHQRTHTGERPYTCEECGKAFSRSSFLVQHQRIHTGVKPYGCEQCGKTFRCRSFLTQHQRIHTGEKPYKCNECGNSFRNHSHLTEHQRIHTGEKPYKCNRCGKAFNQNTHLIHHQRIHTGEKPYICSECGSSFRKHSNLTQHQRIHTGEKPHKCDECGKTFQTKANLSQHQRIHSGEKPYKCKECGKAFCQSPSLIKHQRIHTGEKPYKCKECGKAFTQSTPLTKHQRIHTGERPYKCSECGKAFIQSICLIRHQRSHTGEKPYKCNECGKGFNQNTCLTQHMRIHTGEKPYKCKECGKAFAHSSSLTEHHRTHTGEKLYKCSECEKTFRKYAHLSEHYRIHTGEKPYECIECGKFFRHSSVLFRHQKLHSGD

SEQ ID NO: 752314 - protein, 544 aa, Homo sapiens; identical to SEQ ID NO: 752312

SEQ ID NO: 752315 - protein, 168 aa, Homo sapiens
LLLNTRPPKQAFTQSTPLTKHQRIHTGERPYKCSECGKAFIQSICLIRHQRSHTGEKPYKCNECGKGFNQNTCLTQHMRIHTGEKPYKCKECGKAFAHSSSLTEHHRTHTGEKLYKCSECEKTFRKYAHLSEHYRIHTGEKPYECIECGKFFRHSSVLFRHQKLHSGD

SEQ ID NO: 752316 - protein, 39 aa, Homo sapiens
MHARKANDAGHHQELGEAQGRSPSALEGPSPGHTFISDL

SEQ ID NO: 752317 - protein, 273 aa, Homo sapiens
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSRRNPSYPWLWEDGSPLMPHLFRVRGAVSQTYPSGTCAYIQRGAVYAENCILAAFSICQKKANLRAQ

SEQ ID NO: 752318 - protein, 220 aa, Homo sapiens
MVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSRRNPSYPWLWEDGSPLMPHLFRVRGAVSQTYPSGTCAYIQRGAVYAENCILAAFSICQKKANLRAQ

SEQ ID NO: 752319 - protein, 273 aa, Homo sapiens; identical to SEQ ID NO: 752317

SEQ ID NO: 752320 - protein, 201 aa, Homo sapiens
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDFSFSFRASASIIYLSSLADSCEASS

SEQ ID NO: 752321 - protein, 273 aa, Homo sapiens; identical to SEQ ID NO: 752317

SEQ ID NO: 752322 - protein, 227 aa, Homo sapiens
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSRRNPSYPWLWEDGSPLMPHL

SEQ ID NO: 752323 - protein, 189 aa, Homo sapiens
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLI

SEQ ID NO: 752324 - protein, 78 aa, Homo sapiens
YQLWGPGGRHAGGCKLQHSKTLGLCQGDPVIWALPGPQPARQMQHPLQGRPVESLGSLFLDPVIQVFMLCSRGPHERA

SEQ ID NO: 752325 - protein, 102 aa, Homo sapiens
CIISLCSLQPQQIHSYTQNLQDYLPSFSIYQILIFLCNSLLESPSSKRIFFIQVSIFLNTTLLTATPLQHFFFSRYLAIVYLSFGIKFDSCFITTLPKQQCF

SEQ ID NO: 752326 - protein, 102 aa, Homo sapiens; identical to SEQ ID NO: 752325

SEQ ID NO: 752327 - protein, 114 aa, Homo sapiens
FLSYTSAQKEELFDVICQECRLFSCVNSSLYNPDHSILVVRAREGVWIPVRLSRPWKASPSVHIITEILQKILKALLALNCCFNFSHYGMIAVTATATAAGSCFAFPQYKQQTM

SEQ ID NO: 752328 - protein, 179 aa, Homo sapiens
MGVEREGGKSQCGERVDQTGLAPWAPLSEPRPGLRGRPYKWLWAETEKSVPVSPHVCLHHCHRDPAAMSYPVTSQPQCATTSCYQTQLSDWHTGLTDCCNDMPVCLCGTFAPLCLACRISDDFGECCCAPYLPGGLHSIRTGMRERYHIQGSVGHDWAALTFCLPCALCQMARELKIRE

SEQ ID NO: 752329 - protein, 31 aa, Homo sapiens
MVQKKLTEGEQDEASNAAMLLEKETQNENNS

SEQ ID NO: 752330 - protein, 189 aa, Homo sapiens
MFDFLSKELVRLQEERRIHAFVMLAERQRRVREAEESGRRQVEKQRLREEDEIFKEVAKVHHSTISSYLEDIILNTEANTAEEQARAEIEKMAEKINDIAYEMESRRTYLQSEEIVAELVYSFLIPEVQKYFVKEKVRNAQRKHILAAHQIIHSYTESMVQKKLTEGEQDEASNAAMLLEKETQNENNS

SEQ ID NO: 752331 - protein, 733 aa, Homo sapiens
MFSNLIHYPRYSLYWSKSDPVPPFISREWKGHKEKHREALRQLTTTDASFQMPKEVYEDPEVTGKNRYKYFERPFLPFFQQMPFNVVYAVSKWSLAPSLRLECSGVISARCNLHLQGSSDSPSSASQVAGITGQNHTLFLLLLLSTYPSLQSLLWALRLIIGMLTFKQIHTLQKYVVCQDSIPELLTLATLTWGRGLPAGQAEVEMIERAREKRAWEASLPALSDTSQFEKRRKMMNEMERKEWAFREQEIEKLQEIRLEVLKELLRKREENQNEVNMKHLNARWSKLQEGKEAKMAKIQRTHVSTIRKLVGKRKNIEGKLERRNIIKDYSDYASQVYGPLSRLGCFPDNNSEDFVVKNYYLNTYEGLVELESCLPDFVTQPQIRAPKPKVITTKAGFLKRAARLDYELAEVHKALLDKKNKVLEVKKPPRFLQRNPIPQPRLPTPTLEMTSNEEEEMEMAVIYLQKLLRGRVVQNMMFEGKEKRLELIQELRTCHALQEDEKLVKKAEKQVTLALQRQRNLHEHKVSLVENHLAGLEGRALADMFDFLSKELVRLQEERRIHAFVMLAERQRRVREAEESGRRQVEKQRLREEDEIFKEVVKVHHSTISSYLEDIILNTEANTAEEQARAEIEKMAEKINDIAYEMESRRTYLQSEEIVAELVYSFLIPEVQKYFVKEKVRNAQRKHILAAHQIIHSYTESMVQKKLTEGEQDEASNAAMLLEKETQNENNS

SEQ ID NO: 752332 - protein, 553 aa, Homo sapiens
MFSNLIHYPRYSLYWSKSDPVPPFISREWKGHKEKHREALRQLTTTDASFQMPKEVYEDPEVTGKNRYKYFERPFLPFFQQMPFNVVYAVSKWSLAPSLRLECSGVISARCNLHLQGSSDSPSSASQVAGITGQNHTLFLLLLLSTYPSLQSLLWALRLIIGMLTFKQIHTLQKYVVCQDSIPELLTLATLTWGRGLPAGQAEVEMIERAREKRAWEASLPALSDTSQFEKRRKMMNEMERKEWAFREQEIEKLQEIRLEVLKELLRKREENQNEVNMKHLNARWSKLQEGKEAKMAKIQRTHVSTIRKLVGKRKNIEGKLERRNIIKDYSDYASQVYGPLSRLGCFPDNNSEDFVVKNYYLNTYEGLVELESCLPDFVTQPQIRAPKPKVITTKAGFLKRAARLDYELAEVHKALLDKKNKVLEVKKPPRFLQRNPIPQPRLPTPTLEMTSNEEEEMEMAVIYLQKLLRGRVVQNMMFEGKEKRLELIQELRTCHALQEDEKLVKKAEKQVTLALQRQRNLHEHKVFLFLFSCYFLVKFSPLILSSHSTIII

SEQ ID NO: 752333 - protein, 189 aa, Homo sapiens; identical to SEQ ID NO: 752330

SEQ ID NO: 752334 - protein, 31 aa, Homo sapiens; identical to SEQ ID NO: 752329

SEQ ID NO: 752335 - protein, 31 aa, Homo sapiens; identical to SEQ ID NO: 752329

SEQ ID NO: 752336 - protein, 75 aa, Homo sapiens
GVRGQFFGAVISMSLTDCSRGNAYCDLLTCDLSTCRLPALGSVRARKSLWSRSQSWDGIQGTTKVSLSLSILKNE

SEQ ID NO: 752337 - protein, 106 aa, Homo sapiens
MTFIIIVLLVYVTFCPLIQQTFMDTSHVLGIALGMVVGLVALCIPGEIPAQSASTITSNVSESILRCGEVFFFFFYFTNFPDGFSLLKVYLERGHLTAFIFSSTCF

SEQ ID NO: 752338 - protein, 135 aa, Homo sapiens
HFFRAKVSPCWPTSASQGAGITGVSHARPAHLCVILIQHLLSAYCMFGIKWWSLISKDLESRGQKLKRLVLCTSESAHRLNKYGKKIFPTAEEFSVPRAQSRTHSSHPPVAVATPSSRSPSAHSYGSPGLSPAIE

SEQ ID NO: 752339 - protein, 164 aa, Homo sapiens
HFFRAKVSPCWPTSASQGAGITGVSHARPAHLCVILIQHLLSAYCMFGIKWWSLISKDLESRGQKLKRLVLCTSESAHRLNKYSGGSTAVLTVEFRRGDQAPSPPTSEIQHQFQGSRTRARGRLTLSPRLRGRRSPEAQARQGQRDRETQGPRGSGRLKTQVRL

SEQ ID NO: 752340 - protein, 907 aa, Homo sapiens
MYARLRIGGDGGRAGTRRGRPPGQRRQPLLPGALRTPQRPPAAAACLALPGTMSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSEALIHLGAKFSPCMRQDPQVHSFIRSAREREKHSACCVRNDRSGCVQTSEEECSSTLAVWVKWPIHPSAPELAGHKRQFGSVCHQDPRVCDEPSSEDPHEWPEDITKWPICTKNSAGNHTNHPHMDCVITGRPCCIGTKGRCEITSREYCDFMRGYFHEEATLCSQVHCMDDVCGLLPFLNPEVPDQFYRLWLSLFLHAGILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 752341 - protein, 948 aa, Homo sapiens
MYARLRIGGDGGRAGTRRGRPPGQRRQPLLPGALRTPQRPPAAAACLALPGTMSEARRDSTSSLQRKKPPWLKLDIPSAVPLTAEEPSFLQPLRRQAFLRSVSMPAETAHISSPHHELRRPVLQRQTSITQTIRRPWSLEWLQAWGRACCPGGGPLKSPAWEGRSGRPLLSPCHARGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSEALIHLGAKFSPCMRQDPQVHSFIRSAREREKHSACCVRNDRSGCVQTSEEECSSTLAVWVKWPIHPSAPELAGHKRQFGSVCHQDPRVCDEPSSEDPHEWPEDITKWPICTKNSAGNHTNHPHMDCVITGRPCCIGTKGRCEITSREYCDFMRGYFHEEATLCSQVHCMDDVCGLLPFLNPEVPDQFYRLWLSLFLHAGILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 752342 - protein, 1078 aa, Homo sapiens
MYARLRIGGDGGRAGTRRGRPPGQRRQPLLPGALRTPQRPPAAAACLALPGTMSEARRDSTSSLQRKKPPWLKLDIPSAVPLTAEEPSFLQPLRRQAFLRSVSMPAETAHISSPHHELRRPVLQRQTSITQTIRRPWSLEWLQAWGRACCPGGGPLKSPAWEGRSGRPLLSPCHARGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSEALIHLGAKFSPCMRQDPQVHSFIRSAREREKHSACCVRNDRSGCVQTSEEECSSTLAVWVKWPIHPSAPELAGHKRQFGSVCHQDPRVCDEPSSEDPHEWPEDITKWPVSCSGGVVREPSVSCGGECHTPPTGDTRDSHHGTTSRFQRLCTCPLYSLSINQRLPLRASRSRELDGDLKGQVTLFQFDRDSVWWPAGSQGSHTVFCFMSPPIFASTPKRGVGPKVGGGPGLSSSSFVTQICTKNSAGNHTNHPHMDCVITGRPCCIGTKGRCEITSREYCDFMRGYFHEEATLCSQVHCMDDVCGLLPFLNPEVPDQFYRLWLSLFLHAGILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 752343 - protein, 221 aa, Homo sapiens [sequence omitted]

SEQ ID NO: 752344 - protein, 943 aa, Homo sapiens
MYARLRIGGDGGRAGTRRGRPPGQRRQPLLPGALRTPQRPPAAAACLALPGTMSEARRDSTSSLQRKKPPWLKLDIPSAVPLTAEEPSFLQPLRRQAFLRSVSMPAETAHISSPHHELRRPVLQRQTSITQTIRSSRQVRFGRVHTLPLLGPRAARRAFPQRQSLSWSLLRGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSEALIHLGAKFSPCMRQDPQVHSFIRSAREREKHSACCVRNDRSGCVQTSEEECSSTLAVWVKWPIHPSAPELAGHKRQFGSVCHQDPRVCDEPSSEDPHEWPEDITKWPICTKNSAGNHTNHPHMDCVITGRPCCIGTKGRCEITSREYCDFMRGYFHEEATLCSQVHCMDDVCGLLPFLNPEVPDQFYRLWLSLFLHAGILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 752345 - protein, 1118 aa, Homo sapiens
MYARLRIGGDGGRAGTRRGRPPGQRRQPLLPGALRTPQRPPAAAACLALPGTMSEARRDSTSSLQRKKPPWLKLDIPSAVPLTAEEPSFLQPLRRQAFLRSVSMPAETAHISSPHHELRRPVLQRQTSITQTIRRPWSLEWLQAWGRACCPGGGPLKSPAWEGRSGRPLLSPCHARGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSEALIHLGAKFSPCMRQDPQVHSFIRSAREREKHSACCVRNDRSGCVQTSEEECSSTLAVWVKWPIHPSAPELAGHKRQFGSVCHQDPRVCDEPSSEDPHEWPEDITKWPVSCSGGVVREPSVSCGGECHTPPTGDTRDSHHGTTSRFQRLCTCPLYSLSINQRLPLRASRSRELDGDLKGQVTLFQFDRDSVWWPAGSQGSHTVFCFMSPPIFASTPKRGVGPKVGGGPGLSSSSFVTQICTKNSAGNHTNHPHMDCVITGRPCCIGTKGRCEITSREYCDFMRGYFHEEATLCSQVHCMDDVCGLLPFLNPEVPDQFYRLWLSLFLHAGQVTLWAGSGVSGPSGWLAGGGRKVTSLLNVSRPPPATDYRILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 752346 - protein, 185 aa, Homo sapiens
ALYARLRIGGDGGRAGTRRGRPPGQRRQPLLPGALRTPQRPPAAAACLALPGTMSEARRDSTSSLQRKKPPWLKLDIPSAVPLTAEEPSFLQVGPGLQGLWVPPVQYPHHDPVAQPLRRQAFLRSVSMPAETAHISSPHHELRRPVLQRQTSITQTIRRYQHRPAAPWGGSWGLVGQRQVHRGWK

SEQ ID NO: 752347 - protein, 176 aa, Homo sapiens
VTSVAFRGGTKMDSSRARQQLRRRFLLLPDAEAQLDREGDAGPETSTAVEKKEKPLPRLNIHSGFWILASIVVTYYVDFFKTLKENFHTSSWFLCGSALLLVSLSIAFYCIVYLEWYCGIGEYDVKYPALIPITTASFIAAGICFNIALWHVWSFFTPLLLFTQFMGVVMFITLLG

SEQ ID NO: 752348 - protein, 74 aa, Homo sapiens
VTSVAFRGGTKMDSSRARQQLRRRFLLLPDAEAQLDREGDAGPGEARTKPPRGSQRRGVGKRPASGSPGPVWKD

SEQ ID NO: 752349 - protein, 176 aa, Homo sapiens; identical to SEQ ID NO: 752347

SEQ ID NO: 752350 - protein, 162 aa, Homo sapiens
VTSVAFRGGTKMDSSRARQQLRRRFLLLPETSTAVEKKEKPLPRLNIHSGFWILASIVVTYYVDFFKTLKENFHTSSWFLCGSALLLVSLSIAFYCIVYLEWYCGIGEYDVKYPALIPITTASFIAAGICFNIALWHVWSFFTPLLLFTQFMGVVMFITLLG

SEQ ID NO: 752351 - protein, 176 aa, Homo sapiens; identical to SEQ ID NO: 752347

SEQ ID NO: 752352 - protein, 176 aa, Homo sapiens; identical to SEQ ID NO: 752347

SEQ ID NO: 752353 - protein, 842 aa, Homo sapiens
MRQSFPSTQHWSQACLCSDTWRCSVFHSTTLQGCFLLCSPLHPESLYLFALNGEISDTQKATVVHMDCASPGLLGRPPPFWECRELTYRMGLLLQYVDDLFIVSQTWQDSDFNIIKTLNFLAERGYKVSPIQGPDFFTEVPISGVHSDPRSPNTSCGLEKAITSLLVPQTKRQPQGFLGMVGFCSIWIPNYGLTAKPLCETQKGEEREPLYWEKKCQQSFEPLKTELGQALVLGLPEKNHFTLYVCERLGIALGVLTQRLGPVQKPVAHFSKQTNPVAQKRPGCWRAVAATALLFSEASKLTQGQYTEAMTPHQVQTGLEVKGHHWLTAGRLTNYQALLLDTLDITLRVCQTLNTATSLPTTDDEDSQHQCTGPTKQTPAGLACEISLLRMQRRNDILMAVALWRETQKAGHAVVSLKETTETKALPPQNGTKSSTRGLNRASQLGEREGVNLYTNSKYRFLLLCAHAAIWKEKGMLTVKNSPGKRKDPIQLLLEAAQLPCQVAVIHCKGHQRDWSLISQGNRATKQATWLQESSNVLALMTDPPTFLITYNTHNKSKRKLRGRGTRKTVLDGSQMVTSFIPGTDQLKVTKHLHDATHYWRDVLWNSVHKIFTRKKLRKSVKQVTFVSELCSRNNPHTHPIPPSGLKLVQHRGTYLGEDWQVVLTQMTPNLGYKYLLVFVDTFTGRVKGFPTCTEKAVEVCKPSLKEVISQFGLPKSPQSGNRLSFMGKITQSLSTTLGIDYELAPQSSGKVKMNHTLETTLAKLFQEMHESWVKMLPVFSGSAGPLRAAYRLSSSQMIYQRPFLTTDLLLGEELHKKLQYRFRTDSKGDFRIWKQNPASPH

SEQ ID NO: 752354 - protein, 124 aa, Homo sapiens [sequence omitted]

SEQ ID NO: 752355 - protein, 819 aa, Homo sapiens
MVGFCSIWIPNYGLTAKPLCETQKGEEREPLYWEKKCQQSFEPLKTELGQALVLGLPEKNHFTLYVCERLGIALGVLTQRLGPVQKPVAHFSKQTNPVAQKRPGCWRAVAATALLFSEASKLTQGQYTEAMTPHQVQTGLEVKGHHWLTAGRLTNYQALLLDTLDITLRVCQTLNTATSLPTTDDEDSQHQCTGPTKQTPAGLACEISLLRMQRRNDILMAVALWRETQKAGHAVVSLKETTETKALPPQNGTKSSTRGLNRASQLGEREGVNLYTNSKYRFLLLCAHAAIWKEKGMLTVKNSPGKRKDPIQLLLEAAQLPCQVAVIHCKGHQRDWSLISQGNMGHKTGNLVIGIQQCVGLNDRPYQTFLITYNTHNKSKRKLRGRGTRKTVLDGSQMVTSFIPGTDQLKVTKHLHDATHQWRDVLWNSVHKIFTRKKLRKSVKQVTFVSELCSRNNPHTHPIPPSGLKLVQHRGTYLGEDWQVVLTQMTPNLGYKYLLVFVDTFTGRVKGFPTCTEKAVEVCKPSLKEVISQFGLPKSPQSGNRLSFMGKITQSLSTTLGIDYELAPQSSGKVKMNHTLETTLAKLFQEMHESWVKMLPVFSGSAGPLRAAYRLSSSQMIYQRPFLTTDLLLGEELQKNYSIDLGQIQKVTSEYGNKILPVPTKDGKTPLQVNPGDQVLLKAWRAGSPEDHPLLKWEGPYWVILTTPTAANSQGITSWVHLSRSEMLSPKCFQTRPDGPFTPENLWKTSNSGEPIHHRRSNVVRDLESNTFPCITNWFTIILLLLLSLLPQVKTSFVPAGYKDATLYFVPTPPHQGTG

SEQ ID NO: 752356 - protein, 842 aa, Homo sapiens; identical to SEQ ID NO: 752353

SEQ ID NO: 752357 - protein, 1236 aa, Homo sapiens
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 752358 - protein, 161 aa, Homo sapiens
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKERPNSCPLVPQAWNQAGVGGALVLGSWD

SEQ ID NO: 752359 - protein, 1236 aa, Homo sapiens; identical to SEQ ID NO: 752357

SEQ ID NO: 752360 - protein, 748 aa, Homo sapiens
MTLEDGGWGVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 752361 - protein, 447 aa, Homo sapiens
MPWDQAGTIVAGPSAEGAAYGLSSPYCPGHLQLLQRGAEPRQPTAAGQPGPHGQLGPGQRAQDAAGSPRHGDHGGRKQLPGPRHSHHRELGWRPPCAPTVPLPDPAVWPQPMPAHPRPAPRAEPHGLGTARRGSRGACAQGSAAPGPPPDAGAAPVRRLPSVAPPSLGGAVAGADRALREAPLGLRAAPVARALSLQLLSSSRPIRPPLPPALPGAPGAGGPAAARSGAAGPAGGPAARGLGPGLAPASRFPAQLRGRGLRSAQLAARWVHRPRLRPPRRPLGLQALGAGAVDVLADLPGGLPGGRAGRGPRLAAQTARLPARPRPPAILLGGCLSSPSTLCQPRLLALRGLGASGAQGQDSGAGHRLQRQWGTGRDQQGSPWDARLPGTLHLETDLQSGVRSVSYQPLRLRASWILCLPLSGLSGRQDWAFLASTMKSWPWDPSDR

SEQ ID NO: 752362 - protein, 122 aa, Homo sapiens
HLENTGVAWTAFKTFCSDYASPHWGWALGWVWGFGAWKAGGRVVLAAALRLQFQRPQDQYPPFRFGTVPNGSTERNIRSNYRDMHTHMVKFNQRSVEDALTSLKMGWVPSPAPAVFIRVSPQ

SEQ ID NO: 752363 - protein, 114 aa, Homo sapiens
LQDSCGVEGRGLGAEWSLRQKWKATMCLRTQLWCQSKFSLSLRWWLGPSLSLRSTERVGRKGGVSSGNRQSPGHSAEEGGRGPHPIQDPREPDKSLPIGPSRGCPAGSCGLDPC

SEQ ID NO: 752364 - protein, 1129 aa, Homo sapiens
RGSGTDTAREAAWRGLSSRAQRPFPSEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 752365 - protein, 855 aa, Homo sapiens
MKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 752366 - protein, 1042 aa, Homo sapiens
CIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDEKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERKFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYRSNCAENIRKHILHTGKHEGVKMYNCPKCDYGTNVPVEFRNHLKEQHPDIENPDLAYLHAGKGQKL

SEQ ID NO: 752367 - protein, 982 aa, Homo sapiens
CIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDEKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERKFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYSAYDWV

SEQ ID NO: 752368 - protein, 1475 aa, Homo sapiens
CIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDEKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERKFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYRSNCAENIRKHILHTGKHEGVKMYNCPKCDYGTNVPVEFRNHLKEQHPDIENPDLAYLHAGIVSKSYECRLKGQGATFVETDSPFTAAALAEEPLVKEKPLRSSRRPAPPPEQVQQVIIFQGYDGEFALDPSVEETAAATLQTLAMAGQVARVVHITEDGQVIATSQSGAHVGSVVPGPILPEQLADGATQVVVVGGSMEGHGMDESLSPGGAVIQQVTKQEILNLSEAGVAPPEASSALDALLCAVTELGEVEGRAGLEEQGRPGAKDVLIQLPGQEVSHVAADPEAPEIQMFPQAQESPAAVEVLTQVVHPSAAMASQERAQVAFKKMVQGVLQFAVCDTAAAGQLVKDGVTQVVVSEEGAVHMVAGEGAQIIMQEAQGEHMDLVESDGEISQIIVTEELVQAMVQESSGGFSEGTTHYILTELPPGVQDEPGLYSHTVLETADSQELLQAGATLGTEAGAPSRAEQLASVVIYTQEGSSAAAAIQSQRESSELQEA

SEQ ID NO: 752369 - protein, 887 aa, Homo sapiens
CIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDEKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERVKVAYRKIGTLPGIQNNRNASSASEAQSLCEHFS

SEQ ID NO: 752370 - protein, 1386 aa, Homo sapiens
CIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDEKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERKFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYRSNCAENIRKHILHTGKHEGVKMYNCPKCDYGTNVPVEFRNHLKEQHPDIENPDLAYLHAGIVSKSYECRLKGQGATFVETDSPFTAAALAEEPLVKEKPLRSSRRPAPPPEQVQQVIIFQGYDGEFALDPSVEETAAATLQTLAMAGQVARVVHITEDGQVIATSQSGAHVGSVVPGPILPEQLADGATQVVVVGGSMEGHGMDESLSPGGAVIQQVTKQEILNLSEAGVAPPEASSALDALLCAVTELGEVEGRAGLEEQGRPGAKDVLIQLPGQEVSHVAADPEAPEIQMFPQAQESPAAVEVLTQVVHPSAAMASQERAQVAFKKMVQGVLQFAVCDTAAAGQLVKDGVTQVVVSEEGAVHMVAGEGAQIIMQEAQGEHMDLVESDGEIIADHRGFTAAVGCEFLS

SEQ ID NO: 752371 - protein, 361 aa, Homo sapiens
NIHKYTPAYKDHKHLASAFRSYKMINSTSTQPPDESCSQNLLITQQIIPVLYCMVFIAGILLNGVSGWIFFYVPSSKSFIIYLKNIVIADFVMSLTFPFKILGDSGLGPWQLNVFVCRVSAVLFYVNMYVSIVFFGLISFDRYYKIVKPLWTSFIQSVSYSKLLSVIVWMLMLLLAVPNIILTNQSVREVTQIKCIELKSELGRKWHKASNYIFVAIFWIVFLLLIVFYTAITKKIFKSHLKSSRNSTSVKKKSSRNIFSIVFVFFVCFVPYHIARIPYTKSQTEAHYSCQSKEILRYMKEFTLLLSAANVCLDPIIYFFLCQPFREILCKKLHIPLKAQNDLDISRIKRGNTTLESTDTL

SEQ ID NO: 752372 - protein, 338 aa, Homo sapiens
MINSTSTQPPDESCSQNLLITQQIIPVLYCMVFIAGILLNGVSGWIFFYVPSSKSFIIYLKNIVIADFVMSLTFPFKILGDSGLGPWQLNVFVCRVSAVLFYVNMYVSIVFFGLISFDRYYKIVKPLWTSFIQSVSYSKLLSVIVWMLMLLLAVPNIILTNQSVREVTQIKCIELKSELGRKWHKASNYIFVAIFWIVFLLLIVFYTAITKKIFKSHLKSSRNSTSVKKKSSRNIFSIVFVFFVCFVPYHIARIPYTKSQTEAHYSCQSKEILRYMKEFTLLLSAANVCLDPIIYFFLCQPFREILCKKLHIPLKAQNDLDISRIKRGNTTLESTDTL

SEQ ID NO: 752373 - protein, 232 aa, Homo sapiens
MANYYEVLGVQASASPEDIKKAYRKLALRWHPDKNPDNKEEAEKKFKLVSEAYEVLSDSKKRSLYDRAGCDSWRAGGGASTPYHSPFDTGYTFRNPEDIFREFFGGLDPFSFEFWDSPFNSDRGGRGHGLRGAFSAGFGEFPAFMEAFSSFNMLGCSGGSHTTFSSTSFGGSSSGSSGFKSVMSSTEMINGHKVTTKRIVENGQERVEVEEDGQLKSVTVNGKEQLKWMDSK

SEQ ID NO: 752374 - protein, 76 aa, Homo sapiens
LRQRLYVIFHRYRDVFPQGLPDEYAFVTTFRFRKTSRKEDWYIWQVIDQYSIPQLSVPMKVGQLSTSTQSGEEREI

SEQ ID NO: 752375 - protein, 345 aa, Homo sapiens
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQLSVPMKVGQLSTSTQSGEEREI

SEQ ID NO: 752376 - protein, 369 aa, Homo sapiens
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVGAMKDAVRVVFRGSRVNDLFDRDWHKMAL

SEQ ID NO: 752377 - protein, 184 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKMVILDEADSMTSAAQGGLRRTMGKGRKHPIWLICTMSVE

SEQ ID NO: 752378 - protein, 251 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKMVILDEADSMTSAAQAALRRTMEKESKTTRFCLICNYVSRIIEPLTSRCSKFRFKPLSDKIPQQGLLDIAKKENVKISDEGIAYLVKVSEGDFKKSHYISSKRYSD

SEQ ID NO: 752379 - protein, 251 aa, Homo sapiens; identical to SEQ ID NO: 752378

SEQ ID NO: 752380 - protein, 234 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKMVILDEADSMTSAAQAALRRTMEKESKTTRFCLICNYVSRIIEPLTSRCSKFRFKPLSDKIPQQGLLDIATPATVHFSERDRPVRVRGS

SEQ ID NO: 752381 - protein, 282 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKMVILDEADSMTSAAQAALRRTMEKESKTTRFCLICNYVSRIIEPLTSRCSKFRFKPLSDKIPQQGLLDIAKKENVKISDEGIAYLVKVSEGDLRKAITFLQSATPINQGGKGIHGRKGITDIGGYIQVGEIDGVIGA

SEQ ID NO: 752382 - protein, 121 aa, Homo sapiens
LPVNNPPLGTYLPYLTLLRELLREHTDHSLPKPGPLSPDSPAIITPGDQVLVKDLQARGLSPQWKGPYTVILTTPTAAKLIGLPSWYHISHLKKAPTQHQATWTVTSLSPTKLKLSPSNTA

SEQ ID NO: 752383 - protein, 109 aa, Homo sapiens
SPREAPETAGGEGSLAQPGCVWDWGQASHTYDSGSAVPHLSGRCVCLQTPVCISPSASFTLSLSVSVSMSDPLGHTFNRHGDTSPGPQPCDLCPPSHSSERFHQLQKAH

SEQ ID NO: 752384 - protein, 282 aa, Homo sapiens
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGESKTYVIPLQCSCPVDFEFYITLIQSHQAFAIEPTSGIIPANGKMTVTIKFTPFQYGTAQIKMQLWISQFNSQPYECVFTGTCYPNMALPLEEFERLNTLSKKVNVPP

SEQ ID NO: 752385 - protein, 516 aa, Homo sapiens
MGTLAMTLACSVSGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGELPAKPPRWLSFEGMLLFYTDSGLPGPGAPASAVGSANGVMYFSSLVSFLGCLYSSLFVIYEIPPSDAADEEHRPLLLNVLTSRSLDSGHAPAPGGLEQADQ

SEQ ID NO: 752386 - protein, 549 aa, Homo sapiens
LLFNGCILFGIEFSYAMETAYVTPVLLQMGLPDQLYSLVWFISPILGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGELPAKPPRWLSFEGMLLFYTDSGLPGPGAPDLAVGSANGVMYFSSLVSFLGCLYSSLFVIYEIPPSDAADEEHRPLLLNVLTSRSLDSGHAPAPGGLEQADQ

SEQ ID NO: 752387 - protein, 72 aa, Homo sapiens
QLQIDSSYKPNFRNQDLVLDINKVKLLQDVRKLLVSYDHRLDYLCSKHMIMEGGRTVYFGMNTTVSDEDSLP

SEQ ID NO: 752388 - protein, 213 aa, Homo sapiens
MEAIWLYQFRLIVIGDSTVGKSCLIRRFTEGRFAQVSDPTVGVDFFSRLVEIEPGKRIKLQIWDTAGQERFRSITRAYYRNSVGGLLLFDITNRRSFQNVHEWLEETKVHVQPYQIVFVLVGHKCDLDTQRQVTRHEAEKLAAAYGMKYIETSARDAINVEKAFTDLTRDIYELVKRGEITIQEGWEGVKSGFVPNVVHSSEEVVKSERRCLC

SEQ ID NO: 752389 - protein, 726 aa, Homo sapiens
MTGDPFAGPGISDLSFSHQRNMWTYQLKFILPEGETYCLIIKYTIFCFLSQIKCRTQPNNCYLMMAVENTCKHDKCTCMSAFVIYCCMTNCHNLVAYYTPVYNLTAFVGYESRHNLSGSSNSASFTGFSQDVSQDWISFKGSTGKDLLSSSQKHGRIQSLELFELKVSVPSWFPFSYISILSNIEACFIKACRLRRQYNLQIRQNHKLYNPIMVCEYCYSLLVKNKSLKSLNLVTCLILTLPGLHMRVNTRRRGHWEPSQQSSTVSELDNQHCKYQEMALTGESVCFQRCPLTMYRSWSWQQHLIGKVALFLHFCCLAVSCPFTAVSSCLCLTVLFPLSLQHLAELLLGLDFTSSQAAGSWSFPPNPSQGKVPLLNALKMLCLCQSTYHILINCLSSRLEFKLCGDRDHIHLILFGSPVPSTSQLLNKYWHDEEIVPLGVLLFHFNKCDSLKLYSEIFCVCTTFHVNEFSHLESLFEKKYHVIQIFDMEKVVSDILVIRKEHLKGTSFGNTMMLKWMLIFILGRKCELKSNKNRKRSLLILACSYLPEKCTDARMGMKNSMHLLGFGYSKLAFSDLVMINLTICLLFFLFISSTLILNFGSDFSLNEVKIQLGNEMTPSKTELTFCNYKGKKKQQQQQTYIRLICKSQVLLCFMLLSYIELGYFIYIHNGYFQWFDENHFYVQKLEDLTGKVIIDKLIVILKVHSLKLYPICCYNTFFFWWFDFSP

SEQ ID NO: 752390 - protein, 118 aa, Homo sapiens
LVRWGLALLPRLECSGAISAHCNLCLLGSSNSPASVSQVAGTTGTHHHAQLIFVFLVETGFCHIGQAGLKLLTSGDPPTSASQSAGITGVSHHAQPRFFFEALNYFANQDKKLRRVPE

SEQ ID NO: 752391 - protein, 224 aa, Homo sapiens
TQSLIKDLKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 752392 - protein, 556 aa, Homo sapiens
QRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSEPRCAWQSLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 752393 - protein, 550 aa, Homo sapiens
QRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 752394 - protein, 377 aa, Homo sapiens
QRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSEPRCAWQSLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKVGEMKFPLHKCPRDQAEGTLHGLCLKLHLAWLLSLSCSAFYTFLLFCLVSSALINHLHMNI

SEQ ID NO: 752395 - protein, 106 aa, Homo sapiens; identical to SEQ ID NO: 752226

SEQ ID NO: 752396 - protein, 187 aa, Homo sapiens
MRQKSHRHLYQSITPRPVSKANRSRVLSWKVCFPIGCSIARSLWGLETKGQQQIHVIIYGLQTPASARLRPPSLPVHQPVAPVGRGVSTSRLLETSFLLRQEAKDCVPSTSTWLPPPGKSHGSLWHHAPPGTCRGSCHQPPEPLFLRGKWAYSSERKFHREYAWQFSLGLLGSPTPLPLTSALSTAC

SEQ ID NO: 752397 - protein, 106 aa, Homo sapiens
THHNGTSSKSIYGEKFDDENFILKHTGPGILSMANAGPNTNSSQFFICTAKTEWLDGKHVVFGKAKEGMNIVEAIEHFGSRNGKTSKKITTADCGQLLISLTCVLS

SEQ ID NO: 752398 - protein, 591 aa, Homo sapiens
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKK

SEQ ID NO: 752399 - protein, 591 aa, Homo sapiens; identical to SEQ ID NO: 752398

SEQ ID NO: 752400 - protein, 1037 aa, Homo sapiens
MQFFDAEELLVDEEDDVFGEGLPTRLPEIMLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKCKPAVSRSRSSSLSLTVESALESFDFLNTSDFDEEEDGDEVCNVGGGADSVFSDTETEKHSYRSVHPEARGHLSEALTEDTGVGTSVAGSPLPLTTGNESLDITIVRHLQYCTQLVQQIVFSSKTPFVARSLLEKLAAVSDENIGNISSVVEAIPEFHKKLSLLSFWTKCCSPVGVYHSPADRVMKQLEASFARTVNKEYPGLADPVFRTLVSQILDRAEPLLSSSLSSEVVTVFQYYSYFTSHGVSDLESYLSQLARQVSMVQTLQSLRDEKLLQTMSDLAPSNLLAQQEVLRTLALLLTREDNEVSEAVTLYLAAASKNQHFREKALLYYCEALTKTNLQLQKAACLALKILEATESIKMLVTLCQSDTEEIRNVASETLLSLGEDGRLAYEQLDKFPRDCVKVGGRHGTEVATAF

SEQ ID NO: 752401 - protein, 1008 aa, Homo sapiens
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKCKPAVSRSRSSSLSLTVESALESFDFLNTSDFDEEEDGDEVCNVGGGADSVFSDTETEKHSYRSVHPEARGHLSEALTEDTGVGTSVAGSPLPLTTGNESLDITIVRHLQYCTQLVQQIVFSSKTPFVARSLLEKLAAVSDENIGNISSVVEAIPEFHKKLSLLSFWTKCCSPVGVYHSPADRVMKQLEASFARTVNKEYPGLADPVFRTLVSQILDRAEPLLSSSLSSEVVTVFQYYSYFTSHGVSDLESYLSQLARQVSMVQTLQSLRDEKLLQTMSDLAPSNLLAQQEVLRTLALLLTREDNEVSEAVTLYLAAASKNQHFREKALLYYCEALTKTNLQLQKAACLALKILEATESIKMLVTLCQSDTEEIRNVASETLLSLGEDGRLAYEQLDKFPRDCVKVGGRHGTEVATAF

SEQ ID NO: 752402 - protein, 642 aa, Homo sapiens
MQFFDAEELLVDEEDDVFGEGLPTRLPEIMLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKDAKHLDDQKLNGAASWTEITEGE

SEQ ID NO: 752403 - protein, 1068 aa, Homo sapiens
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDVEDMTASSGAGNKAAALQRRMSMYSQGTPETPTFKDHSFFRWLHPSPDKPRRLSVLSALQDTFFAKLHRSRSFSDLPSLRPSPKAVLELYSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKCKPAVSRSRSSSLSLTVESALESFDFLNTSDFDEEEDGDEVCNVGGGADSVFSDTETEKHSYRSVHPEARGHLSEALTEDTGVGTSVAGSPLPLTTGNESLDITIVRHLQYCTQLVQQIVFSSKTPFVARSLLEKLSRQIQVMEKLAAVSDENIGNISSVVEAIPEFHKKLSLLSFWTKCCSPVGVYHSPADRVMKQLEASFARTVNKEYPGLADPVFRTLVSQILDRAEPLLSSSLSSEVVTVFQYYSYFTSHGVSDLESYLSQLARQVSMVQTLQSLRDEKLLQTMSDLAPSNLLAQQEVLRTLALLLTREDNEVSEAVTLYLAAASKNQHFREKALLYYCEALTKTNLQLQKAACLALKILEATESIKMLVTLCQSDTEEIRNVASETLLSLGEDGRLAYEQLDKFPRDCVKVGGRHGTEVATAF

SEQ ID NO: 752404 - protein, 264 aa, Homo sapiens
MLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIESGGLEEILLGKNSSINDEQVWPGFAPPLFLDDHYDNFHESMGGQAGGTWKATRTYMAAKTGMGKNKVLAL

SEQ ID NO: 752405 - protein, 1008 aa, Homo sapiens; identical to SEQ ID NO: 752401

SEQ ID NO: 752406 - protein, 286 aa, Homo sapiens
MEKLAAVSDENIGNISSVVEAIPEFHKKLSLLSFWTKCCSPVGVYHSPADRVMKQLEASFARTVNKEYPGLADPVFRTLVSQILDRAEPLLSSSLSSEVVTVFQYYSYFTSHGVSDLESYLSQLARQVSMVQTLQSLRDEKLLQTMSDLAPSNLLAQQEVLRTLALLLTREDNEVSEAVTLYLAAASKNQHFREKALLYYCEALTKTNLQLQKAACLALKILEATESIKMLVTLCQSDTEEIRNVASETLLSLGEDGRLAYEQLDKFPRDCVKVGGRHGTEVATAF

SEQ ID NO: 752407 - protein, 346 aa, Homo sapiens
MQFFDAEELLVDEEDDVFGEGLPTRLPEIMLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVQYCHCLLSFLVPRLDDPLVGPLPVTPACCPSIPQTSLHKSITKTAALSSE

SEQ ID NO: 752408 - protein, 340 aa, Homo sapiens
MSELEQLRQEAEQLRNQIQDARKACNDATLVQITSNMDSVGRIQMRTRRTLRGHLAKIYAMHWGYDSRLLVSASQDGKLIIWDSYTTNKMHAIPLRSSWVMTCAYAPSGNYVACGGLDNICSIYNLKTREGNVRVSRELPGHTGYLSCCRFLDDSQIVTSSGDTTCALWDIETAQQTTTFTGHSGDVMSLSLSPDMRTFVSGACDASSKLWDIRDGMCRQSFTGHVSDINAVSFFPNGYAFATGSDDATCRLFDLRADQELLLYSHDNIICGITSVAFSKSGRLLLAGYDDFNCNVWDTLKGDRAGVLAGHDNRVSCLGVTDDGMAVATGSWDSFLRIWN

SEQ ID NO: 752409 - protein, 236 aa, Homo sapiens [sequence omitted]

SEQ ID NO: 752410 - protein, 340 aa, Homo sapiens; identical to SEQ ID NO: 752408

SEQ ID NO: 752411 - protein, 340 aa, Homo sapiens; identical to SEQ ID NO: 752408

SEQ ID NO: 752412 - protein, 236 aa, Homo sapiens [sequence omitted]

SEQ ID NO: 752413 - protein, 113 aa, Homo sapiens
PRPLSGLLATPGRMCGGGVLQAKRELRADRGSAPDWGTQCKRRGQREGTECGPLRKEDAAGGGESCSGSGVRAGPVLEWAWSPVGRVRFLLSVTGLVGSDLKVHSGCGVGSRW

SEQ ID NO: 752414 - protein, 628 aa, Homo sapiens
MSTATTVAPAGIPATPGPVNPPPPEVSNPSKPGRKTNQLQYMQNVVVKTLWKHQFAWPFYQPVDAIKLNLPDYHKIIKNPMDMGTIKKRLENNYYWSASECMQDFNTMFTNCYIYNKPTDDIVLMAQALEKIFLQKVAQMPQEEVELLPPAPKGKGRKPAAGAQSAGTQQVAAVSSVSPATPFQSVPPTVSQTPVIAATPVPTITANVTSVPVPPAAAPPPPATPIVPVVPPTPPVVKKKGVKRKADTTTPTTSAITASRSESPPPLSDPKQAKVVARRESGGRPIKPPKKDLEDGEVPQHAGKKGKLSEHLRYCDSILREMLSKKHAAYAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERATRLAELQEQLKAVHEQLAALSQAPVNKPKKKKEKEGEGEEEEGQGEGEGEAQSEWPMEEKKAKVAPPAKQAQQKKAPAKKANSTTTAGRQLKKGGKQASASYDSEEEEEGLPMSYDEKRQLSLDINRLPGEKLGRVVHIIQSREPSLRDSNPDEIEIDFETLKPTTLR

SEQ ID NO: 752415 - protein, 501 aa, Homo sapiens
MSTATTVAPAGIPATPGPVNPPPPEVSNPSKPGRKTNQLQYMQNVVVKTLWKHQFAWPFYQPVDAIKLNLPDYHKIIKNPMDMGTIKKRLENNYYWSASECMQDFNTMFTNCYIYNKPTDDIVLMAQALEKIFLQKVAQMPQEEVELLPPAPKGKGRKPAAGAQSAGTQQVAAVSSVSPATPFQSVPPTVSQTPVIAATPVPTITANVTSVPVPPAAAPPPPATPIVPVVPPTPPVVKKKGVKRKADTTTPTTSAITASRSESPPPLSDPKQAKVVARRESGGRPIKPPKKDLEDGEVPQHAGKKGKLSEHLRYCDSILREMLSKKHAAYAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERATRLAELQEQLKAVHEQLAALSQAPVNKPKKKKEKEGETFPL

SEQ ID NO: 752416 - protein, 414 aa, Homo sapiens
MSTATTVAPAGIPATPGPVNPPPPEVSNPSKPGRKTNQLQYMQNVVVKTLWKHQFAWPFYQPVDAIKLNLPDYHKIIKNPMDMGTIKKRLENNYYWSASECMQDFNTMFTNCYIYNKPTDDIVLMAQALEKIFLQKVAQMPQEEVELLPPAPKGKGRKPAAGAQSAGTQQVAAVSSVSPATPFQSVPPTVSQTPVIAATPVPTITANVTSVPVPPAAAPPPPATPIVPVVPPTPPVVKKKGVKRKADTTTPTTSAITASRSESPPPCLRPQETNQRRRRRKKEKEKKKKDKEKEKEKHKVKAEEEKKAKVAPPAKQAQQKKAPAKKANSTTTAGRQLKKGGKQASASYDSEEEEEGLPMSYDEKRQLSLDINRLPGEKLGRVVHIIQSREPSLRDSNPDEIEIDFETLKPTTLR

SEQ ID NO: 752417 - protein, 312 aa, Homo sapiens
MQNVVVKTLWKHQFAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERATRLAELQEQLKAVHEQLAALSQAPVNKPKKKKEKEGEGEEEEGQGEGEGEAQSEGLMEEKKAKVAPPAKQAQQKKAPAKKANSTTTAGRQLKKGGKQASASYDSEEEEEGLPMSYDEKRQLSLDINRLPGEKLGRVVHIIQSREPSLRDSNPDEIEIDFETLKPTTLR

SEQ ID NO: 752418 - protein, 1829 aa, Homo sapiens
MEDTPPSLSCSDCQRHFPSLPELSRHRELLHPSPNQDSEEADSIPRPYRCQQCGRGYRHPGSLVNHRRTHETGLFPCTTCGKDFSNPMALKSHMRTHAPEGRRRHRPPRPKEATPHLQGETVSTDSWGQRLGSSEGWENQTKHTEETPDCESVPDPRAASGTWEDLPTRQREGLASHPGPEDGADGWGPSTNSARAPPLPIPASSLLSNLEQYLAESVVNFTGGQEPTQSPPAEEERRYKCSQCGKTYKHAGSLTNHRQSHTLGIYPCAICFKEFSNLMALKNHSRLHAQYRPYHCPHCPRVFRLPRELLEHQQSHEGERQEPRWEEKGMPTTNGHTDESSQDQLPSAQMLNGSAELSTSGELEDSGLEEYRPFRCGDCGRTYRHAGSLINHRKSHQTGVYPCSLCSKQLFNAAALKNHVRAHHRPRQGVGENGQPSVPPAPLLLAETTHKEEEDPTTTLDHRPYKCSECGRAYRHRGSLVNHRHSHRTGEYQCSLCPRKYPNLMALRNHVRVHCKAARRSADIGAEGAPSHLKVELPPDPVEAEAAPHTDQDHVCKHEEEATDITPAADKTAAHICSICGLLFEDAESLERHGLTHGAGEKENSRTETTMSPPRAFACRDCGKSYRHSGSLINHRQTHQTGDFSCGACAKHFHTMAAMKNHLRRHSRRRSRRHRKRAGGASGGREAKLLAAESWTRELEDNEGLESPQDPSGESPHGAEGNLESDGDCLQAESEGDKCGLERDETHFQGDKESGGTGEGLERKDASLLDNLDIPGEEGGGTHFCDSLTGVDEDQKPATGQPNSSSHSANAVTGWQAGAAHTCSDCGHSFPHATGLLSHRPCHPPGIYQCSLCPKEFDSLPALRSHFQNHRPGEATSAQPFLCCLCGMIFPGRAGYRLHRRQAHSSSGMTEGSEEEGEEEGVAEAAPARSPPLQLSEAELLNQLQREVEALDSAGYGHICGCCGQTYDDLGSLERHHQSQSSGTTADKAPSPLGVAGDAMEMVVDSVLEDIVNSVSGEGGDAKSQEGAGTPLGDSLCIQGGESLLEAQPRPFRCNQCGKTYRHGGSLVNHRKIHQTGDFLCPVCSRCYPNLAAYRNHLRNHPRCKGSEPQVGPIPEAAGSSELQVGPIPEGGSNKPQHMAEEGPGQAEVEKLQEELKVEPLEEVARVKEEVWEETTVKGEEIEPRLETAEKGCQTEASSERPFSCEVCGRSYKHAGSLINHRQSHQTGHFGCQACSKGFSNLMSLKNHRRIHADPRRFRCSECGKAFRLRKQLASHQRVHMERRGGGGTRKATREDRPFRCGQCGRTYRHAGSLLNHRRSHETGQYSCPTCPKTYSNRMALKDHQRLHSENRRRRAGRSRRTAVRCALCGRSFPGRGSLERHLREHEETEREPANGQGGLDGTAASEANLTGSQGLETQLGGAEPVPHLEDGVPRPGERSQSPIRAASSEAPEPLSWGAGKAGGWPVGGGLGNHSGGWVPQFLTRSEEPEDSVHRSPCHAGDCQLNGPTLSHMDSWDNRDNSSQLQPGSHSSCSQCGKTYCQSGSLLNHNTNKTDRHYCLLCSKEFLNPVATKSHSHNHIDAQTFACPDCGKAFESHQELASHLQAHARGHSQVPAQMEEARDPKAGTGEDQVVLPGQGKAQEAPSETPRGPGESVERARGGQAVTSMAAEDKERPFRCTQCGRSYRHAGSLLNHQKAHTTGLYPCSLCPKLLPNLLSLKNHSRTHTDPKRHCCSICGKAFRTAARLEGHGRVHAPREGPFTCPHCPRHFRRRISFVQHQQQHQEEWTVAGSGRGHEGSQEEVGTQWRGKSSPKVGGGARSERREPRGF

SEQ ID NO: 752419 - protein, 1219 aa, Homo sapiens
MSPPRAFACRDCGKSYRHSGSLINHRQTHQTGDFSCGACAKHFHTMAAMKNHLRRHSRRRSRRHRKRAGGASGGREAKLLAAESWTRELEDNEGLESPQDPSGESPHGAEGNLESDGDCLQAESEGDKCGLERDETHFQGDKESGGTGEGLERKDASLLDNLDIPGEEGGGTHFCDSLTGVDEDQKPATGQPNSSSHSANAVTGWQAGAAHTCSDCGHSFPHATGLLSHRPCHPPGIYQCSLCPKEFDSLPALRSHFQNHRPGEATSAQPFLCCLCGMIFPGRAGYRLHRRQAHSSSGMTEGSEEEGEEEGVAEAAPARSPPLQLSEAELLNQLQREVEALDSAGYGHICGCCGQTYDDLGSLERHHQSQSSGTTADKAPSPLGVAGDAMEMVVDSVLEDIVNSVSGEGGDAKSQEGAGTPLGDSLCIQGGESLLEAQPRPFRCNQCGKTYRHGGSLVNHRKIHQTGDFLCPVCSRCYPNLAAYRNHLRNHPRCKGSEPQVGPIPEAAGSSELQVGPIPEGGSNKPQHMAEEGPGQAEVEKLQEELKVEPLEEVARVKEEVWEETTVKGEEIEPRLETAEKGCQTEASSERPFSCEVCGRSYKHAGSLINHRQSHQTGHFGCQACSKGFSNLMSLKNHRRIHADPRRFRCSECGKAFRLRKQLASHQRVHMERRGGGGTRKATREDRPFRCGQCGRTYRHAGSLLNHRRSHETGQYSCPTCPKTYSNRMALKDHQRLHSENRRRRAGRSRRTAVRCALCGRSFPGRGSLERHLREHEETEREPANGQGGLDGTAASEANLTGSQGLETQLGGAEPVPHLEDGVPRPGERSQSPIRAASSEAPEPLSWGAGKAGGWPVGGGLGNHSGGWVPQFLTRSEEPEDSVHRSPCHAGDCQLNGPTLSHMDSWDNRDNSSQLQPGSHSSCSQCGKTYCQSGSLLNHNTNKTDRHYCLLCSKEFLNPVATKSHSHNHIDAQTFACPDCGKAFESHQELASHLQAHARGHSQVPAQMEEARDPKAGTGEDQVVLPGQGKAQEAPSETPRGPGESVERARGGQAVTSMAAEDKERPFRCTQCGRSYRHAGSLLNHQKAHTTGLYPCSLCPKLLPNLLSLKNHSRTHTDPKRHCCSICGKAFRTAARLEGHGRVHAPREGPFTCPHCPRHFRRRISFVQHQQQHQEEWTVAGSGRGHEGSQEEVGTQWRGKSSPKVGGGARSERREPRGF

SEQ ID NO: 752420 - protein, 1829 aa, Homo sapiens; identical to SEQ ID NO: 752418

SEQ ID NO: 752421 - protein, 110 aa, Homo sapiens
MLSSLQRSESGGGSACREGLDLHIFSGVVRASPYLLLSPCEEDPDLASFPRRGWGVPRVPVLEGPPSPSLITVLFSAPPSAARLQHQGEADAEPHRWESCLWKGAFCYNL

SEQ ID NO: 752422 - protein, 1829 aa, Homo sapiens; identical to SEQ ID NO: 752418

SEQ ID NO: 752423 - protein, 359 aa, Homo sapiens
MGNHSGGWVPQFLTRSEEPEDSVHRSPCHAGDCQLNGPTLSHMDSWDNRDNSSQLQPGSHSSCSQCGKTYCQSGSLLNHNTNKTDRHYCLLCSKEFLNPVATKSHSHNHIDAQTFACPDCGKAFESHQELASHLQAHARGHSQVPAQMEEARDPKAGTGEDQVVLPGQGKAQEAPSETPRGPGESVERARGGQAVTSMAAEDKERPFRCTQCGRSYRHAGSLLNHQKAHTTGLYPCSLCPKLLPNLLSLKNHSRTHTDPKRHCCSICGKAFRTAARLEGHGRVHAPREGPFTCPHCPRHFRRRISFVQHQQQHQEEWTVAGSGRGHEGSQEEVGTQWRGKSSPKVGGGARSERREPRGF

SEQ ID NO: 752424 - protein, 106 aa, Homo sapiens
STTYGTQCSLRLLQVGGDVVGPECGVLKPRPGKSPQRIPGYLRTAPAGVWPVLPPDFQPSSRHPRRSVCCLLFLECPKVVVSAQDFHRFLNLDSCGPQLCALRILF

SEQ ID NO: 752425 - protein, 47 aa, Homo sapiens
MPLVGQVCKYTSWFPFLVCTPPRPLSELPPSVSCAFINSPEMFRFKF

SEQ ID NO: 752426 - protein, 104 aa, Homo sapiens [sequence omitted]

SEQ ID NO: 752427 - protein, 83 aa, Homo sapiens
GRLSVRGFSKQVEYGTEVHRSSLLTKRVVLVEIRVVLNTVSEADYVECTRAKQARDGLVTVSACMMYGAFVTHTARCAFVFVF

SEQ ID NO: 752428 - protein, 83 aa, Homo sapiens; identical to SEQ ID NO: 752427

SEQ ID NO: 752429 - protein, 119 aa, Homo sapiens
PIVCELLGLATSQDNGQPEGAWAKSPQGTSHKDRATGQRGKTNAREILPAMPGAQGSWPPTRRTAGSTWHWGSAWHRATSSFPLHAHPPPQKQVLCAQQWPWMLGRATHRDHGGPPGQP

SEQ ID NO: 752430 - protein, 667 aa, Homo sapiens
PPPPPPPPPALPGPGPVSVPELKPESSQTPVVSTRKGKCRGVRRMVVKMAKIPVSLGRRNKTTYKVSSLSSSLSVEGKELGLRVSAEPTPLLKMKNNGRNVVVVFPPGEMPIILKRKRGRPPKNLLLGPGKPKEPAVVAAEAATVAAATMAMPEVKKRRRRKQKLASPQPSYAADANDSKAEYSDVLAKLAFLNRQSQCAGRCSPPRCWTPSEPESVHQAPDTQSISHFLHRVQGFRRRGGKAGGFGGRGGGHAAKSARCSFSDFFEGIGKKKKVVAVAAAGVGGPGLTELGHPRKRGRGEVDAVTGKPKRKRRSRKNGTLFPEQVPSGPGFGEAGAEWAGDKGGGWAPHHGHPGGQAGRNCGFQGTEARAFASTGLESGASGRGSYYSTGAPSGQTELSQERQNLFTGYFRSLLDSDDSSDLLDFALSASRPESRKASGTYAGPPTSALPAQRGLATFPSRGAKASPVAVGSSGAGADPSFQPVLSARQTFPPGRAASYGLTPATSDCRAAETFPKLVPPPSAMARSPTTHPPANTYLPQYGGYGAGQSVFAPTKPFTGQDCANSKDCSFAYGSGNSLPASPSSAHSAGYAPPPTGGPCLPPSKASFFSSSEGAPFSGSAPTPLRCDSRASTVSPGGYMVPKGTTASATSAASAASSSSSSFQPSP

SEQ ID NO: 752431 - protein, 282 aa, Homo sapiens
PPPPPPPPPALPGPGPVSVPELKPESSQTPVVSTRKGKCRGVRRMVVKMAKIPVSLGRRNKTTYKVSSLSSSLSVEGKELGLRVSAEPTPLLKMKNNGRNVVVVFPPGEMPIILKRKRGRPPKNLLLGPGKPKEPAVVAAEAATVAAATMAMPEVKKRRRRKQKLASPQPSYAADANDSKAEYSDVLAKLAFLNRQSQCAGRCSPPRCWTPSEPESVHQAPGPCFPPGPLPAHLTRPSPPTPSPRTHAHPHAGTPAPGAHQSLPRGTTRCPHGQPVLSHRPA

SEQ ID NO: 752432 - protein, 72 aa, Homo sapiens
DIQLASGVQSDQVSGCHTPEGRWGHEESENPWVSVCVGTRTKLQDSQVHGQFLRGPPGDLKSKKHGILSQLL

SEQ ID NO: 752433 - protein, 106 aa, Homo sapiens
PRLECSAVMSAHCNLRLLCSSHSPATASRVAGITGTCHHTWLIFVFLVEMGFHHVGQAGLELLTSGDPPASASQSSGITGMSHCARPHPSFLIHLVTNSQINCFYL

SEQ ID NO: 752434 - protein, 50 aa, Homo sapiens
MPVCPCLICVCFVLRLQSGVAGTETERPPHGAASLHQDRGATLRLCFFPS

SEQ ID NO: 752435 - protein, 388 aa, Homo sapiens
MTASVLLHPRWIEPTVMFLYDNGGGLVADELNKNMEGAAAAAAAAAAAAAAGAGGGGFPHPAAAAAGGNFSVAAAAAAAAAAAANQCRNLMAHPAPLAPGAASAYSSAPGEAPPSAAAAAAAAAAAAAAAAAASSSGGPGPAGPAGAEAAKQCSPCSAAAQSSSGPAALPYGYFGSGYYPCARMGPHPNAIKSCAQPASAAAAAAFADKYMDTAGPAAEEFSSRAKEFAFYHQGYAAGPYHHHQPMPGYLDMPVVPGLGGPGESRHEPLGLPMESYQPWALPNGWNGQMYCPKEQAQPPHLWKSTLPDVVSHPSDASSYRRGRKKRVPYTKVQLKELEREYATNKFITKDKRRRISATTNLSERQVTIWFQNRRVKEKKVINKLKTTS

SEQ ID NO: 752436 - protein, 262 aa, Homo sapiens
MTASVLLHPRWIEPTVMFLYDNGGGLVADELNKNMEGAAAAAAAAAAAAAAGAGGGGFPHPAAAAAGGNFSVAAAAAAAAAAAANQCRNLMAHPAPLAPGAASAYSSAPGEAPPSAAAAAAAAAAAAAAAAAASSSGGPGPAGPAGAEAAKQCSPCSAAAQSSSGPAALPYGYFGSGYYPCARMGPHPNAIKSCAQPASAAAAAAFADKYMDTAGPAAEEFSSRAKEFAFYHQGYIAETMICEWVPSQNCLEGCVGEEGWMG

SEQ ID NO: 752437 - protein, 388 aa, Homo sapiens; identical to SEQ ID NO: 752435

SEQ ID NO: 752438 - protein, 241 aa, Homo sapiens
EKPHKCTECGKSFNEKSTLIVHQRTHTGEKPYECDVCGKTFTQKSNLGVHQRTHSGEKPFECNECEKAFSQKSYLMLHQRGHTGEKPYECNECEKAFSQKSYLIIHQRTHTEEKPYKCNECGKASEKSQSLIIHQRIHTGEKPYECPVCWKAFSQKSQLIIHQRTHTGEKPYACTECGKAFREKSTFTVHQRTHTGEKPYKCTECGKAFTQKSNLIVHQRTHAGKKAHGRGHTRKSKFMAH

SEQ ID NO: 752439 - protein, 241 aa, Homo sapiens; identical to SEQ ID NO: 752438

SEQ ID NO: 752440 - protein, 790 aa, Homo sapiens
MMCYHCTPDWTKEFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 752441 - protein, 877 aa, Homo sapiens
LAVAPQASRAGVRAGGWWRLRGCTAGPGQAVAMELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 752442 - protein, 80 aa, Homo sapiens
FYLLSFTLMTRFFGSHLHFAPEARDSFSFPYFCPGDHRDGHTVSLQEMPGEAIAKFQTPSQTQRAEPSPRIHVSNLSGDL

SEQ ID NO: 752443 - protein, 79 aa, Homo sapiens
MEVFQEYYGLPPPPGAIGPFLRLNPGDIVELTKAEAEQNWWEGRNTSTNEIGWFPCNRVKPYVHGPPQDLSVHLCTQAP

SEQ ID NO: 752444 - protein, 845 aa, Homo sapiens
LAVAPQASRAGVRAGGWWRLRGCTAGPGQAVAMELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 752445 - protein, 125 aa, Homo sapiens [sequence omitted]

SEQ ID NO: 752446 - protein, 519 aa, Homo sapiens
MMCYHCTPDWTKEFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDLPGT

SEQ ID NO: 752447 - protein, 448 aa, Homo sapiens
MMCYHCTPDWTKEFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAM

SEQ ID NO: 752448 - protein, 470 aa, Homo sapiens
MEPGSAVGGPGSPLPPPQDLAQCVNEVKRDNETLRQITNFQLSIENLDQSLAHYGRPKIDGELKITSVERRSKMDSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 752449 - protein, 192 aa, Homo sapiens
MGTQARGRPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 752450 - protein, 414 aa, Homo sapiens
MMCYHCTPDWTKEFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKVGL

SEQ ID NO: 752451 - protein, 127 aa, Homo sapiens
MEDDLGRVGWEELTFWAEPESCFMSSEKQSAGLSQATTAAAVWLPMVGALFSFSGPHCLPRKADPGRGEACGSSVPFSLPSMSAGQQESGDWEALSAPMLKSAFVGCMEQPASPSCQCCPVLGLLGP

SEQ ID NO: 752452 - protein, 911 aa, Homo sapiens
ERRRSASPSASQSASPPAQYLSLLGPRKLSAVCLARTAAEALIMATFISVQLKKTSEVDLAKPLVKFIQQTYPSGGEEQAQYCRAAEELSKLRRAAVGRPLDKHEGALETLLRYYDQICSIEPKFPFSENQICLTFTWKDAFDKGSLFGGSVKLALASLGYEKSCVLFNCAALASQIAAEQNLDNDEGLKIAAKHYQFASGAFLHIKETVLSALSREPTVDISPDTVGTLSLIMLAQAQEVFFLKATRDKMKDAIIAKLANQAADYFGDAFKQCQYKDTLPKEVFPVLAAKHCIMQANAEYHQSILAKQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLVNRSIAQMREATTLANGVLASLNLPAAIEDVSGDTVPQSILTKSRSVIEQGGIQTVDQLIKELPELLQRNREILDESLRLLDEEEATDNDLRAKFKERWQRTPSNELYKPLRAEGTNFRTVLDKAVQADGQVKECYQSHRDTIVLLCKPEPELNAAIPSANPAKTMQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 752453 - protein, 615 aa, Homo sapiens
NGPGWYRSECEDQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLVNRSIAQMREATTLANGVLASLNLPAAIEDVSGDTVPQSILTKSRSVIEQGGIQTVDQLIKELPELLQRNREILDESLRLLDEEEATDNDLRAKFKERWQRTPSNELYKPLRAEGTNFRTVLDKAVQADGQVKECYQSHRDTIVLLCKPEPELNAAIPSANPAKTMQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 752454 - protein, 663 aa, Homo sapiens
HSVPLHPVGPLVQSCHGEKKVTYKDLEATSAAFLEVFPVLAAKHCIMQANAEYHQSILAKQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLVNRSIAQMREATTLANGVLASLNLPAAIEDVSGDTVPQSILTKSRSVIEQGGIQTVDQLIKELPELLQRNREILDESLRLLDEEEATDNDLRAKFKERWQRTPSNELYKPLRAEGTNFRTVLDKAVQADGQVKECYQSHRDTIVLLCKPEPELNAAIPSANPAKTMQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 752455 - protein, 678 aa, Homo sapiens
ERRRSASPSASQSASPPAQYLSLLGPRKLSAVCLARTAAEALIMATFISVQLKKTSEVDLAKPLVKFIQQTYPSGGEEQAQYCRAAEELSKLRRAAVGRPLDKHEGALETLLRYYDQICSIEPKFPFSENQICLTFTWKDAFDKGSLFGGSVKLALASLGYEKSCVLFNCAALASQIAAEQNLDNDEGLKIAAKHYQFASGAFLHIKETVLSALSREPTVDISPDTVGTLSLIMLAQAQEVFFLKATRDKMKDAIIAKLANQAADYFGDAFKQCQYKDTLPKEVFPVLAAKHCIMQANAEYHQSILAKQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLVNRSIAQMREATTLANGVLASLNLPAAIEDVSGDTVPQSILTKSRSVIEQGGIQTVDQLIKELPELLQRNREILDESLRLLDEEEATDNDLRAKFKERWQRTPSNELYKPLRAEGTNFRTVLDKAVQADGQVKECYQSHRDTIVLLCKPEPELNAAIPSANPAKTMQGSEVVNVLKSLLSNLDEVKKEREGLENDLKSVNFDMTSKFLTALAQDGVINEEALSVTELDRVYGGLTTKVQESLKKQEGLLKNIQLSELL

SEQ ID NO: 752456 - protein, 911 aa, Homo sapiens; identical to SEQ ID NO: 752452

SEQ ID NO: 752457 - protein, 336 aa, Homo sapiens
ELLGSGDPPKVLGLQVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 752458 - protein, 230 aa, Homo sapiens
KQEGLLKNIQVSHQEFSLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 752459 - protein, 578 aa, Homo sapiens
MLSCNICGETVTSEPDMKAHLIVHMESEIICPFCKLSGVNYDEMCFHIETAHFEQNTLERNFERINTVQYGTSDNKKDNTLQCGMEVNSSILSGCASNHPKNSAQNLTKDSTLKHEGFYSENLTESRKFLKSREKQSSLTEIKGSVYETTYSPPECPFCGKIEEHSEDMETHVKTKHANLLDIPLEDCDQPLYDCPMCGLICTNYHILQEHVDLHLEENSFQQGMDRVQCSGDLQLAHQLQQEEDRKRRSEESRQEIEEFQKLQRQYGLDNSGGYKQQQLRNMEIEVNRGRMPPSEFHRRKADMMESLALGFDDGKTKTSGIIEALHRYYQNAATDVRRVWLSSVVDHFHSSLGDKGWGCGYRNFQMLLSSLLQNDAYNDCLKGMLIPCIPKIQSMIEDAWKEGFDPQGASQLNNRLQGTKAWIGACEVYILLTSLRVKCHIVDFHKSTGPLGTHPRLFEWILNYYSSEGEGSPKVVCTSKPPIYLQHQGHSRTVIGIEEKKNRTLCLLILDPGCPSREMQKLLKQDIEASSLKQLRKSMGNLKHKQYQILAVEGALSLEEKLARRQASQVFTAEKIP

SEQ ID NO: 752460 - protein, 354 aa, Homo sapiens
MDRVQCSGDLQLAHQLQQEEDRKRRSEESRQEIEEFQKLQRQYGLDNSGGYKQQQLRNMEIEVNRGRMPPSEFHRRKADMMESLALGFDDGKTKTSGIIEALHRYYQNAATDVRRVWLSSVVDHFHSSLGDKGWGCGYRNFQMLLSSLLQNDAYNDCLKGMLIPCIPKIQSMIEDAWKEGFDPQGASQLNNRLQGTKAWIGACEVYILLTSLRVKCHIVDFHKSTGPLGTHPRLFEWILNYYSSEGEGSPKVVCTSKPPIYLQHQGHSRTVIGIEEKKNRTLCLLILDPGCPSREMQKLLKQDIEASSLKQLRKSMGNLKHKQYQILAVEGALSLEEKLARRQASQVFTAEKIP

SEQ ID NO: 752461 - protein, 228 aa, Homo sapiens
MLSCNICGETVTSEPDMKAHLIVHMESEIICPFCKLSGVNYDEMCFHIETAHFEQNTLERNFERINTVQYGTSDNKKDNTLQCGMEVNSSILSGCASNHPKNSAQNLTKDSTLKHEGFYSENLTESRKFLKSREKQSSLTEIKGSVYETTYSPPECPFCGKIEEHSEDMETHVKTKHANLLDIPLEDCDQPLYDCPMCGLICTNYHILQEHVDLHLEENSFQQVALFK

SEQ ID NO: 752462 - protein, 84 aa, Homo sapiens
PNPRGAGAHLYAAPWIQVIRPQTLQGDRTDETRRCSLRRRDIYRIQISAFSPHLHKAISAFSDEKRAAPAVIHSGAGITFGTRK

SEQ ID NO: 752463 - protein, 120 aa, Homo sapiens
MVDPGEKISATLKREFGEEAMNSLQKSRKEMQELERQLHKLLSQEHFEVYKGYVDDSRNTDNCWIETEAVNYRDEIMDHLPLEAGDDAKKVKWVDINDKLELYASLSQFIQLVAEKRGAH

SEQ ID NO: 752464 - protein, 673 aa, Homo sapiens [sequence omitted]

SEQ ID NO: 752465 - protein, 673 aa, Homo sapiens [sequence omitted]

SEQ ID NO: 752466 - protein, 116 aa, Homo sapiens [sequence omitted]

SEQ ID NO: 752467 - protein, 69 aa, Homo sapiens
PHFDFWVAGNLNQPTDQGPSMGRSLKGQFFLCGLGQVTQALSKSVSSSLKQDFWLGTVAHTYNPSYSGG

SEQ ID NO: 752468 - protein, 85 aa, Homo sapiens
RWLKVNNRSLRLLAKQSGPKCRAESNSVTSLPWKSQIRTEPSMPPVTKSFRGRQTSNEVMSHSCRHFVSLHTKLCFDSEDVRKPS

SEQ ID NO: 752469 - protein, 458 aa, Homo sapiens [sequence omitted]

SEQ ID NO: 752470 - protein, 559 aa, Homo sapiens
QHPESGPCRRGVPRGRNPSPLGVRNDQGPGTSYIQGCLCGLHRGGVRSPGLCSQEAVRSCDAGQLQKLGLGDLNENSVENLQQKTLQDLLHELSSWLVLEGMASTITGSQDCIVNHRGEVDGEPELDISPCQQWGEASSPISRNRDSVMTLQSGCFENIESETYLPLKVSSQIDTQDSSVKFCKNEPQDHQESRRLFVMEESTERKVIKGESCSENLQVKLVSDGQELASPLLNGEATCQNGQLKESLDPIDCNCKDIHGWKSQVVSCSQQRGHTEEKPCDHNNCGKILNTSPDGHPYEKIHTAEKQYEGSQCGKNFSQSSELLLHQRDHTEEKPYKCEQCGKGFTRSSSLLIHQAVHTDEKPYKCDKCGKGFTRSSSLLIHHAVHTGEKPYKCDKCGKGFSQSSKLHIHQRVHTGEKPYECEECGMSFSQRSNLHIHQRVHTGERPYKCGECGKGFSQSSNLHIHRCIHTGEKPYQCYECGKGFSQSSDLRIHLRVHTGEKPYHCGKCGKGFSQSSKLLIHQRVHTGEKPYECSKCGKGFSQSSNLHIHQRVHKKDPR

SEQ ID NO: 752471 - protein, 177 aa, Homo sapiens
QYDITVSDLNQPMLVSLLKKKRNDNSEPQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDY

SEQ ID NO: 752472 - protein, 107 aa, Homo sapiens
CLKEKKRKLVSFLNCIENFINNRSPRESHTAKLSLSANEMYYFQPPLFKNNIIFIPVPFILLCIFESAGCLKISISNLWQSSFCFFDSMTLIFSRGSWCQFEKHPEE

SEQ ID NO: 752473 - protein, 363 aa, Homo sapiens
GDHTPRCPQHPTQVTMASLFSGRILIRNNSDQDELDTEAEVSRRLENRLVLLFFGAGACPQCQAFVPILKDFFVRLTDEFYVLRAAQLALVYVSQDSTEEQQDLFLKDMPKKWLFLPFEDDLRRDLGRQFSVERLPAVVVLKPDGDVLTRDGADEIQRLGTACFANWQEAAEVLDRNFQLPEDLEDQEPRSLTECLRRHKSDWFLYDCRLLRHVALGLFCCGISVYLAALSIYALLLFEIETGAAAASILGSGTLVLVAVLTHTLLRAARAARRGLHELSPPSFEDDLARPAEVSKASPRAQPQQGIHRRTPYSTCPEPGDPFGSMATATAPAALEGGWESSLPASRMHRTLSAGLGHWDGVT

SEQ ID NO: 752474 - protein, 73 aa, Homo sapiens
LVYVSQDSTEEQQDLFLKDMPKKWLFLPFEDDLRSEEGQGGLPGGGGMFAESEASILTRVNEQPLCASPYTGN

SEQ ID NO: 752475 - protein, 227 aa, Homo sapiens
GDHTPRCPQHPTQVTMASLFSGRILIRNNSDQDELDTEAEVSRRLENRLVLLFFGAGACPQCQAFVPILKDFFVRLTDEFYVLRAAQLALVYVSQDSTEEQQDLFLKDMPKKWLFLPFEDDLRRDLGRQFSVERLPAVVVLKPDGDVLTRDGADEIQRLGTACFANWQEAAEVLDRNFQLPEDLEDQEPRSLTECLRRHKYRVEKAARGGRDPGGGGGEEGGAGGLF

SEQ ID NO: 752476 - protein, 101 aa, Homo sapiens
GQELGAGPGLPEDAAGTLLPLAAALAALVLVLGFTCLLLAALCGHLGAELARGPGPRRSDWFLYDCRLLRHVALGLFCCGISVYLAGVCWNRTWGMGPWAG

SEQ ID NO: 752477 - protein, 507 aa, Homo sapiens
CGAVTGPAAPRLPPSPQPRRPRALSFPALPCLAFQCSSFCEMTLKASEGESGGSMHTALSDLYLEHLLQKRSRPEAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 752478 - protein, 244 aa, Homo sapiens
CGAVTGPAAPRLPPSPQPRRPRALSFPALPCLAFQCSSFCEMTLKASEGESGGSMHTALSDLYLEHLLQKRSRPEMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPRRFRGPLES

SEQ ID NO: 752479 - protein, 66 aa, Homo sapiens
GPPTPGLWNGYLSPGPVRKLGPHSQKSESPALNITALSFTLPIKSVVALDYHRSTNPYCETVLHVI

SEQ ID NO: 752480 - protein, 478 aa, Homo sapiens
MTASNGQTLTGREVEESRHAARQSLSDLTKLGAIMADDEDCYVVTEAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 752481 - protein, 482 aa, Homo sapiens
CGAVTGPAAPRLPPSPQPRRPRALSFPALPCLAFQCSSFCEMTLKASEGESGGSMHTALSDLYLEHLLQKRSRPEAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTEALQQLQKDSEAIRSQYAHYFDLSLVNNGVDETLKKLQEAFDQACSSPQWVPVSWVY

SEQ ID NO: 752482 - protein, 507 aa, Homo sapiens; identical to SEQ ID NO: 752477

SEQ ID NO: 752483 - protein, 215 aa, Homo sapiens [sequence omitted]

SEQ ID NO: 752484 - protein, 128 aa, Homo sapiens [sequence omitted]

SEQ ID NO: 752485 - protein, 507 aa, Homo sapiens; identical to SEQ ID NO: 752477

SEQ ID NO: 752486 - protein, 370 aa, Homo sapiens
CGAVTGPAAPRLPPSPQPRRPRALSFPALPCLAFQCSSFCEMTLKASEGESGGSMHTALSDLYLEHLLQKRSRPEAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPRRFRGPLES

SEQ ID NO: 752487 - protein, 260 aa, Homo sapiens
CGAVTGPAAPRLPPSPQPRRPRALSFPALPCLAFQCSSFCEMTLKASEGESGGSMHTALSDLYLEHLLQKRSRPEAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKGKFQQGI

SEQ ID NO: 752488 - protein, 174 aa, Homo sapiens
CGAVTGPAAPRLPPSPQPRRPRALSFPALPCLAFQCSSFCEMTLKASEGESGGSMHTALSDLYLEHLLQKRSRPEAVSHPLNTVTEDMYTNGSPAPGSPAQVKGQEVRKVRLIQFEKVTEEPMGITLKLNEKQSCTVARILHGGMIHRQGTLWELWVGFDSGINNLLPVQWCGA

SEQ ID NO: 752489 - protein, 507 aa, Homo sapiens; identical to SEQ ID NO: 752477

SEQ ID NO: 752490 - protein, 490 aa, Homo sapiens
CGAVTGPAAPRLPPSPQPRRPRALSFPALPCLAFQCSSFCEMTLKASEGESGGSMHTALSDLYLEHLLQKRSRPEAVSHPLNTVTEDMYTNGSPAPGSPAQVKGQEGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 752491 - protein, 402 aa, Homo sapiens
MYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 752492 - protein, 178 aa, Homo sapiens
MFPRIDGSQAPNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 752493 - protein, 482 aa, Homo sapiens; identical to SEQ ID NO: 752481

SEQ ID NO: 752494 - protein, 135 aa, Homo sapiens
EWVLLRTTVVAAAAFLDAFQKVADMATNTRGGTRKIGSALTRMCMRHRSIEAKLRQFSSALIDCLINPLRNYKKPSTKRAVLHSGCLSPGFTKLVEWGNPLYAPLQHLEFHPPCFKTNRAAPTSFVSASSSLQLS

SEQ ID NO: 752495 - protein, 94 aa, Homo sapiens
AASDGAGAPKGTQFCKCWKNCKLGLAPPRMNAAAEVQRHCWVAQEQETGRSQFYLSPPPSQSLYGTPWWRSLTWNPVVKSSPSPSPSPSPSLGN

SEQ ID NO: 752496 - protein, 39 aa, Homo sapiens
KHFGLLETALEEEDLASCKSPEYDTVFEDSSSSSGESSF

SEQ ID NO: 752497 - protein, 248 aa, Homo sapiens
MICTFLRAVQYTEKLHRSSAKRLLLPYIVLNKACLKTEPSLRCGLQYQKKTLRPRCILGVTQKTIWTQGPSPRKAKEDGSKQVSVHRSQRGGTAVPTSQKVKEAGRDFTYLIVVLFGISITGGLFYTIFKELFSSSSPSKIYGRALEKCRSHPEVIGVFGESVKGYGEVTRRGRRQHVRFTEYVKDGLKHTCVKFYIEGSEPGKQGTVYAQVKENPGSGEYDFRYIFVEIESYPRRTIIIEDNRSQDD

SEQ ID NO: 752498 - protein, 248 aa, Homo sapiens; identical to SEQ ID NO: 752497

SEQ ID NO: 752499 - protein, 133 aa, Homo sapiens
MICTFLRAVQYTEKLHRSSAKRLLLPYIVLNKACLKTEPSLRCGLQYQKKTLRPRCILGVTQKTIWTQGPSPRKAKEDGSKQVSVHRSQRGGTAVPTSQKVKEAGRDFTYLIVVLFGISITAKNSKYKPLNIF

SEQ ID NO: 752500 - protein, 133 aa, Homo sapiens; identical to SEQ ID NO: 752499

SEQ ID NO: 752501 - protein, 248 aa, Homo sapiens; identical to SEQ ID NO: 752497

SEQ ID NO: 752502 - protein, 248 aa, Homo sapiens; identical to SEQ ID NO: 752497

SEQ ID NO: 752503 - protein, 248 aa, Homo sapiens; identical to SEQ ID NO: 752497

SEQ ID NO: 752504 - protein, 244 aa, Homo sapiens
MIATVQYTEKLHRSSAKRLLLPYIVLNKACLKTEPSLRCGLQYQKKTLRPRCILGVTQKTIWTQGPSPRKAKEDGSKQVSVHRSQRGGTAVPTSQKVKEAGRDFTYLIVVLFGISITGGLFYTIFKELFSSSSPSKIYGRALEKCRSHPEVIGVFGESVKGYGEVTRRGRRQHVRFTEYVKDGLKHTCVKFYIEGSEPGKQGTVYAQVKENPGSGEYDFRYIFVEIESYPRRTIIIEDNRSQDD

SEQ ID NO: 752505 - protein, 133 aa, Homo sapiens [sequence omitted]

SEQ ID NO: 752506 - protein, 38 aa, Homo sapiens
MHPKSWHRDCSTKASVLLCMFEIFHNKMKNGKMGKQKW

SEQ ID NO: 752507 - protein, 142 aa, Homo sapiens
PRLPRLRMLAALSPQSLAPVSPQIRVGTTSPAGGFQPRRGPGRRNGTERESVPARWPGGAGLREPPARQQKRRRRQHPPRSAPALGVAAAGRHECYYSERRCRSIALSQWQGATGLILRAVRGVHLSPAASPAHPAAGTRGR

SEQ ID NO: 752508 - protein, 84 aa, Homo sapiens
LTAGKNTLFAPENTKTDTVAVGQLRVPAVVSGAEREAELGVCRSGPLGPPAPKAWPVASSILTVLPRPRPVGPPAHDRHRWRRF

SEQ ID NO: 752509 - protein, 69 aa, Homo sapiens
MLRKERSRASEPTGGNSYSRGPRKLLRKLPGRQGGRDHGDGEKDPEELRNPCCGRHHMSCVKSESKANP

SEQ ID NO: 752510 - protein, 68 aa, Homo sapiens
VDGHTHSVTHQPDHCSLSGLTNLSISSQGPVVLYTISLPAALPPGLDLSEDETTFPALWEPLVLCRVA

SEQ ID NO: 752511 - protein, 123 aa, Homo sapiens
FENFKIMNAAVACLQDKKPALGNRQEHSGPRTAPSPACPASSGAEVQGYQQQPRHAPPRPRTQAAGASPPCQTTSCRHSHHPWTTQSSRRPWTSCSLPPRSPRGLLMPHPRKRHEASMFRSSK

SEQ ID NO: 752512 - protein, 70 aa, Homo sapiens
MGTTLNCRMCTKASPSQGRHKVSAEPACGSDVYKCAYNEGAGCDIQEQRHPEHAAPAASCKWGLLRMRRV

SEQ ID NO: 752513 - protein, 131 aa, Homo sapiens
MPQAAHSVSAVLEKAQTHAETSKDKKPALGNRQEHSGPRTAPSPACPASSGAEVQGYQQQPRHAPPRPRTQAAGASPPCQTTSCRHSHHPWTTQSSRRPWTSCSLPPRSPRGLLMPHPRKRHEASMFRSSK

SEQ ID NO: 752514 - protein, 94 aa, Homo sapiens
NFVCEHCFGAFRSSYHLKRHILIHTGEKPFECDICDMRFIQKYHLERHKRVHSGEKPYQCERCHQCFSRTDRLLRHKRMCQGCQSKTSDGQFSL

SEQ ID NO: 752515 - protein, 94 aa, Homo sapiens; identical to SEQ ID NO: 752514

SEQ ID NO: 752516 - protein, 108 aa, Homo sapiens [sequence omitted]

SEQ ID NO: 752517 - protein, 103 aa, Homo sapiens
NFVCEHCFGAFRSSYHLKRHILIHTGEKPFECDICDMRFIQKYHLERHKRVHSGEKPYQCERCHQVRLIPATIPHTHFSFPKNQGHPPLLPDKRATSVTRHNS

SEQ ID NO: 752518 - protein, 94 aa, Homo sapiens; identical to SEQ ID NO: 752514

SEQ ID NO: 752519 - protein, 289 aa, Homo sapiens
WSRWARYEVGKHPTTHPTTYPFIHPPICQRIHPSTHPIIYPLTYPPIHLPICHPSTHPSIQSPIQPSIQPFSSVHFPSIYPSTHSLLHPPTYPFIIHLPTHPSIHPSNHLSTHPTISICSFPSIYPSTHSLIRPPIHLSPIYPSIHPLIHPFIHPPTHPSIHLPIHLSPIHPHTGLCRFINIHPCIHIYLFSIHQPSIHSYPSIHLSIQMFIEHLCSGSYLGALLTTKTFLSHIVVYRQIQKKRLSPCLISCSLPWRQDSPSAVCLERGKHTALESETWVSILSPPLIS

SEQ ID NO: 752520 - protein, 239 aa, Homo sapiens
LDEARVKIGRGSTIYPPIQLFPSVHFPPIYPSTNSLIHPPTYPFIIHLPTHPSIHPSNHLSTHPTISICSFPSIYPSTHSLIRPPIHLSPIYPSIHPLIHPFIHPPTHPSIHLPIHLSPIHPHTGLCRFINIHPCIHIYLFSIHQPSIHSYPSIHLSIQMFIEHLCSGSYLGALLTTKTFLSHIVVYRQIQKKRLSPCLISCSLPWRQDSPSAVCLERGKHTALESETWVSILSPPLIS

SEQ ID NO: 752521 - protein, 157 aa, Homo sapiens
WSRWARYEVGKHPTTHPTTYPFIHPPICQRIHPSTHPIIYPLTYPPIHLPICHPSTHPSIQSPIQPSIQPFSSVHFPSIYPSTHSLLHPPTYPFIIHLPTHPSIHPSNHLSTHPTISICSFPSIYPSTHSLIRPPIHLSPIYPSIHPTKGDDTKSSR

SEQ ID NO: 752522 - protein, 69 aa, Homo sapiens
EESFQAVAYGGEIQAESGGFFELRKPSWEFPEAKADGIHWTEHHKGESSTESALEAYRWSPFSIQLSAD

SEQ ID NO: 752523 - protein, 98 aa, Homo sapiens
PFFQTTAMMAPDARTSTTGSWRLQPYTLAEQKGGKAGLGSGRGVAGRAAGGCWGRVDGSLDIWVLGPGLLPETTVCLWGEFCVSPAPEDRLKALQGPG

SEQ ID NO: 752524 - protein, 106 aa, Homo sapiens
VYWKQLHSQVRCFFSLKISKLKAFIRGPSNGQAPPATKSQTSKSRRNCLLPNPSLLSWGRGFFLQGPWASCCWAWAYRLPCPFFPNTEKTPLEMTPKPRLLYGPKQ

SEQ ID NO: 752525 - protein, 107 aa, Homo sapiens
PVHWHARGACACVWTPCEFPFLSVVVVVLSMWLSYCVSPLSLFSGSPMFSLHVGPFGMFSAFRCVWVTQSWVNKPCGWGGATSPRPLTNSVPLGARQPLAVVLLFWI

SEQ ID NO: 752526 - protein, 106 aa, Homo sapiens
ETDSSFVTQAGVQWGNLSSLQPLPPGFKQFFCLSLLSTGTTGAHHHAQLIFVFLVETGVHHVGQAGLELLTSGDPPALASESAGITGMSHHAWLRSLFSVFSQVIS

SEQ ID NO: 752527 - protein, 197 aa, Homo sapiens
PGTLTGSPLQSLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYLPLEPMTTMTAWIRWQSEISSVNGLHCEVEPCQADASASPVIDVEMDLETFELVSECVFECTTIKSLRKLQGSKCFSRRLVIRIRGP

SEQ ID NO: 752528 - protein, 187 aa, Homo sapiens
MASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 752529 - protein, 131 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKH

SEQ ID NO: 752530 - protein, 187 aa, Homo sapiens; identical to SEQ ID NO: 752528

SEQ ID NO: 752531 - protein, 187 aa, Homo sapiens; identical to SEQ ID NO: 752528

SEQ ID NO: 752532 - protein, 131 aa, Homo sapiens; identical to SEQ ID NO: 752529

SEQ ID NO: 752533 - protein, 187 aa, Homo sapiens; identical to SEQ ID NO: 752528

SEQ ID NO: 752534 - protein, 131 aa, Homo sapiens; identical to SEQ ID NO: 752529

SEQ ID NO: 752535 - protein, 131 aa, Homo sapiens; identical to SEQ ID NO: 752529

SEQ ID NO: 752536 - protein, 187 aa, Homo sapiens; identical to SEQ ID NO: 752528

SEQ ID NO: 752537 - protein, 131 aa, Homo sapiens; identical to SEQ ID NO: 752529

SEQ ID NO: 752538 - protein, 149 aa, Homo sapiens
MLLGFVPCTSPFYSSFGRCHGLPSPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKH

SEQ ID NO: 752539 - protein, 135 aa, Homo sapiens
MASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 752540 - protein, 131 aa, Homo sapiens; identical to SEQ ID NO: 752529

SEQ ID NO: 752541 - protein, 135 aa, Homo sapiens; identical to SEQ ID NO: 752539

SEQ ID NO: 752542 - protein, 131 aa, Homo sapiens; identical to SEQ ID NO: 752529

SEQ ID NO: 752543 - protein, 164 aa, Homo sapiens
MTYRAHILQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 752544 - protein, 131 aa, Homo sapiens; identical to SEQ ID NO: 752529

SEQ ID NO: 752545 - protein, 154 aa, Homo sapiens
MDSSPLEGEGRLADTFVSLLLSARGRRRRSIVKVSLHPAVMSKSESPKEPEQLRKLFIGGLSFETTDESLRSHFEQWGTLTDCVVMRDPNTKRSRGFGFVTYATVEEVDAAMTMTAITTEAEAALAVVVEAILEVVEATMILGITTISLQILDP

SEQ ID NO: 752546 - protein, 118 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREEAILEVVEATMILGITTISLQILDP

SEQ ID NO: 752547 - protein, 131 aa, Homo sapiens; identical to SEQ ID NO: 752529

SEQ ID NO: 752548 - protein, 131 aa, Homo sapiens; identical to SEQ ID NO: 752529

SEQ ID NO: 752549 - protein, 131 aa, Homo sapiens; identical to SEQ ID NO: 752529

SEQ ID NO: 752550 - protein, 31 aa, Homo sapiens
MLLGFVPCTSPFYSSFGRCHGLPLPKFKSPF

SEQ ID NO: 752551 - protein, 131 aa, Homo sapiens; identical to SEQ ID NO: 752529

SEQ ID NO: 752552 - protein, 131 aa, Homo sapiens; identical to SEQ ID NO: 752529

SEQ ID NO: 752553 - protein, 131 aa, Homo sapiens; identical to SEQ ID NO: 752529

SEQ ID NO: 752554 - protein, 131 aa, Homo sapiens; identical to SEQ ID NO: 752529

SEQ ID NO: 752555 - protein, 135 aa, Homo sapiens; identical to SEQ ID NO: 752539

SEQ ID NO: 752556 - protein, 131 aa, Homo sapiens; identical to SEQ ID NO: 752529

SEQ ID NO: 752557 - protein, 131 aa, Homo sapiens; identical to SEQ ID NO: 752529

SEQ ID NO: 752558 - protein, 131 aa, Homo sapiens; identical to SEQ ID NO: 752529

SEQ ID NO: 752559 - protein, 146 aa, Homo sapiens
MFLYKASYVMFAKVEVVLETLVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP

SEQ ID NO: 752560 - protein, 108 aa, Homo sapiens
MTFHVELQLRQDCRLASAECRGMRYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 752561 - protein, 117 aa, Homo sapiens
MGRSKDPLFVCYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 752562 - protein, 131 aa, Homo sapiens; identical to SEQ ID NO: 752529

SEQ ID NO: 752563 - protein, 115 aa, Homo sapiens
MDSSPLEGEGRLADTFVSLLLSARGRRRRSIVKVSLHPAVMSKSESPKEPEQLRKLFIGGLSFETTDESLRSHFEQWGTLTDCVVMRDPNTKRSRGFGFVTYATVEEVDAAMNMF

SEQ ID NO: 752564 - protein, 201 aa, Homo sapiens
MDSSPLEGEGRLADTFVSLLLSARGRRRRSIVKVSLHPAVMSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYYDSYNNGGGGGFGGGSGRYPVIQVLGVTARLAF

SEQ ID NO: 752565 - protein, 105 aa, Homo sapiens
MSIYFPIHCPDYLRSAKMTEVMMNTQPMEEIGLSPRKDGLSYQIFPDPSDFDRCCKLKDRLPSIVVEPTEGEVESGELRWPPEEFLVQEDEQDNCEETAKENKEQ

SEQ ID NO: 752566 - protein, 105 aa, Homo sapiens; identical to SEQ ID NO: 752565

SEQ ID NO: 752567 - protein, 105 aa, Homo sapiens; identical to SEQ ID NO: 752565

SEQ ID NO: 752568 - protein, 117 aa, Homo sapiens
MSIYFPIHCPDYLRSAKMTEVMMNTQPMEEIGLSPRKDGLSYQIFPDPSDFDRCCKLKDRLPSIVVEPTEGEVESGELRWPPEEFLVQEDEQDNCEETAKENKEQYRVAKRWTQSLP

SEQ ID NO: 752569 - protein, 105 aa, Homo sapiens; identical to SEQ ID NO: 752565

SEQ ID NO: 752570 - protein, 108 aa, Homo sapiens
MRTGTRMPLLALLFNVVLEVLARAIRQQQEIKAIQIGKKDELSLFMDYMILYLKNPKDYTIRLLELIGNYNKVSGYKINVQKSAVTFNLRGPKTGNHSHFLPLGPTKI

SEQ ID NO: 752571 - protein, 68 aa, Homo sapiens
WSGWGSGGTWGLGPWTCPRTWNQGMVGGELFAWETWILLTRREWKWRPPESAAPGPPASLCLMGRWGN

SEQ ID NO: 752572 - protein, 441 aa, Homo sapiens
WWIINPDGGKSGKAPRRRAVSMDNSNKYTKSRGRTAKKKAALQTAPESADDSPSQLSKWSGSPTSRSSDELDAWTDFRSRTNSNASTVSGRLSPIMASTELDEVQDDDAPLSPMLYSSSASLSPSVSKPCTVELLRLTDMAGTMNLNDGADENLMDDLLDNITLPPSQPSPTGGLMQRSSSFPYTTKGSGLSSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSVVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 752573 - protein, 101 aa, Homo sapiens
RRHSFGAIATEEREFGLGSGHRWKFLLPFGAPGHRGEDSGSCGPQASSSPFFCFKEGLRGSGGLKSTVFEMGVMKRVPRKNVLAFDSHRLSGRFPFREGAC

SEQ ID NO: 752574 - protein, 123 aa, Homo sapiens
CHHAWLIFVFLVETEFHHVGQAGLELLTSGNPPASVSPSAGIAGVSLCARHEASLREFPLFKFSELLKFHNILLLGLLNLACILSFMPNCRIFHYSVYQSVPFQLCPGAGHYCTRQLSSYKIL

SEQ ID NO: 752575 - protein, 51 aa, Homo sapiens
TPGFLAGRGSAVPETLKELALRLLGNTPLTRIANFLLALSLSHRGSLATSF

SEQ ID NO: 752576 - protein, 108 aa, Homo sapiens
MVSTGPAHRALRDLSRPSSYLTEASPGRFSLSSGSGDRSAPPPQWPRLGRSCLLQPLKAQLLPLSGFCAPKCPPVSLSWLSSCDLAELLPPVGLYKPSLCCMVASSGP

SEQ ID NO: 752577 - protein, 405 aa, Homo sapiens
AGPLVFMSARGRWEGGGRRACRGSLGLARAQGAERVTSSEQRPAMASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDGCSSHNTATAVAALGGFLYILAEYPPANREPHPSTPPPPSSR

SEQ ID NO: 752578 - protein, 387 aa, Homo sapiens
SGWYRPGMDARAQGAERVTSSEQRPAMASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDGCSSHNTATAVAALGGFLYILAEYPPANREPHPSTPPPPSSR

SEQ ID NO: 752579 - protein, 388 aa, Homo sapiens
AGPLVFMSARGRWEGGGRRACRGSLGLARAQGAERVTSSEQRPAMASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDGCSSHNTATAVAALGGFLYILAESL

SEQ ID NO: 752580 - protein, 381 aa, Homo sapiens
AGPLVFMSARGRWEGGGRRACRGSLGLARAQGAERVTSSEQRPAMASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDPPANREPHPSTPPPPSSR

SEQ ID NO: 752581 - protein, 98 aa, Homo sapiens
WHEEGRGDRDPESWGSRVLGLHVSLLYRLSRSRHGASGHSTTPPAPGCRVWGPPGRISDPSGSSGALGRKNSQTFHSWPGRSTKTRAPARPSSTMSSS

SEQ ID NO: 752582 - protein, 162 aa, Homo sapiens
KIFFSFFPSSSFFSLLPSLPLSPPPSFSFFFFLETTDLTLREGKLVLARISKAQFYFLRQSLALVTQAGVQWRALGSLQLPTPWFRRFFSCLRIPSSWYYRRHHARINFLLLVETGFHHVGQAGLELPTSGDPPASASQSAGITGVSPSARPQSSVLPFFPR

SEQ ID NO: 752583 - protein, 120 aa, Homo sapiens
MDMFIGLESFHSVYIQHHIVPHKYTQLFRCELCPHKDGALKRTDNGGWAHEVCALYIPEVQFANDSTMEPIVLQSVPHDHCNKVETELKLICGRCSGMHWTNTSFPAATTGKSKVFYYEM

SEQ ID NO: 752584 - protein, 114 aa, Homo sapiens
MLKTLPHSCVERTFLFFSPAPQRCELCPHKDGALKRTDNGGWAHEVCALYIPEVQFANDSTMEPIVLQSVPHDHCNKVETELKLICGRCSGMHWDKHLIPAATTGKSKVFYYEM

SEQ ID NO: 752585 - protein, 208 aa, Homo sapiens
MDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 752586 - protein, 208 aa, Homo sapiens; identical to SEQ ID NO: 752585

SEQ ID NO: 752587 - protein, 172 aa, Homo sapiens
MRGSLSFREITVENALLSISCSESGTGVQVRGWNPWAAGQAARPGQGQRAEDRGRAEGRDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 752588 - protein, 208 aa, Homo sapiens; identical to SEQ ID NO: 752585

SEQ ID NO: 752589 - protein, 208 aa, Homo sapiens; identical to SEQ ID NO: 752585

SEQ ID NO: 752590 - protein, 263 aa, Homo sapiens
PRVIGRGVNQAPECRFGGGILGPLGKRRDLARASEPRTEGARRAGPQPRPLADPAMDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 752591 - protein, 208 aa, Homo sapiens; identical to SEQ ID NO: 752585

SEQ ID NO: 752592 - protein, 194 aa, Homo sapiens
MDPFLVLLHSVSSSLSSSELTELKFLCLGRVGKRKLERVQSGLDLFSMLLEQNDLEPGHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 752593 - protein, 135 aa, Homo sapiens [sequence omitted]

SEQ ID NO: 752594 - protein, 103 aa, Homo sapiens
MKGFYMEVKKWPGCTHSRVHLHEGPWCLEEIGQLDPRTRRRSLGIWEWNCPASLMALAQLLQGEGKTLPTPLLQKHCGRLKGRKYPAAPRREDAARARVICTW

SEQ ID NO: 752595 - protein, 112 aa, Homo sapiens
PRAVTMMEGASLLVSETHLQPLSPGGLVCITCCSPWGHPLCSRWAELRGSGSSSDELGLVERRTWGWGCPWIMQGAVAFLVGTGALGKVAIQGGASSCGTQRMVAASPPASH

SEQ ID NO: 752596 - protein, 450 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 752597 - protein, 450 aa, Homo sapiens; identical to SEQ ID NO: 752596

SEQ ID NO: 752598 - protein, 412 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRSCRYTVLGGCGFSGTTSLTMQWWLSWTVCSSSKKRLRKARHVFVFPTGWMWRKARLKTQEAVAAPIPSKPSLTLRSSGQKLSSSC

SEQ ID NO: 752599 - protein, 363 aa, Homo sapiens
MMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 752600 - protein, 397 aa, Homo sapiens [sequence omitted]

SEQ ID NO: 752601 - protein, 388 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKAEVQWHDLGLLQPPPPGFKQFPCLSLLSIWDYRHAPPRPAN

SEQ ID NO: 752602 - protein, 374 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 752603 - protein, 450 aa, Homo sapiens; identical to SEQ ID NO: 752596

SEQ ID NO: 752604 - protein, 114 aa, Homo sapiens
MIHSQFSLLGQELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 752605 - protein, 146 aa, Homo sapiens
ISPHLSAFLCRHSGQFGTINNFRLGRLPSVPVEWNEINAAWGQTVLLLHALANKMGLKFQRSCRYTVLGGCGFSGTTSLTMQWWLSWTVCSSSKKRLRKARHVFVFPTGWMWRKARLKTQEAVAAPIPSKPSLTLRSSGQKLSSSC

SEQ ID NO: 752606 - protein, 364 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKSCRYTVLVARFFLDTPR

SEQ ID NO: 752607 - protein, 162 aa, Homo sapiens
MSKRSPVTFSLRLRFSMVPPSDASPIRVKLLALSVDIILAGGMNLRETPSWRGVSINGSSPELVSSSWVSPGFAWAVVSNGAVSSWMVTRSRILKLVSSFRGWLQRWHTKLTCMVLLLDVLDPSIPREPGARHPSPVYRGGTVASGRPRSEASRTTIALSSA

SEQ ID NO: 752608 - protein, 450 aa, Homo sapiens; identical to SEQ ID NO: 752596

SEQ ID NO: 752609 - protein, 450 aa, Homo sapiens; identical to SEQ ID NO: 752596

SEQ ID NO: 752610 - protein, 388 aa, Homo sapiens; identical to SEQ ID NO: 752601

SEQ ID NO: 752611 - protein, 450 aa, Homo sapiens; identical to SEQ ID NO: 752596

SEQ ID NO: 752612 - protein, 388 aa, Homo sapiens
PSWRGVSINGSSPELVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 752613 - protein, 382 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRMDVEKGKIEDTGGSGGSYSIKTQFNSEEQWTKALKFMLTNLKWGLAWVSSQFYNK

SEQ ID NO: 752614 - protein, 283 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQMDVEKGKIEDTGGSGGSYSIKTQFNSEEQWTKALKFMLTNLKWGLAWVSSQFYNK

SEQ ID NO: 752615 - protein, 450 aa, Homo sapiens; identical to SEQ ID NO: 752596

SEQ ID NO: 752616 - protein, 450 aa, Homo sapiens; identical to SEQ ID NO: 752596

SEQ ID NO: 752617 - protein, 159 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTEGYT

SEQ ID NO: 752618 - protein, 47 aa, Homo sapiens
MQWWLSWTVCSSSKKRLRKARHVFVFPTDDVEKGKIEDTGVIFCRTG

SEQ ID NO: 752619 - protein, 66 aa, Homo sapiens
WARGLWALQLTLRALEDEKKKTDTLLYSVLPPSVCACALGHMGPVRRRVGFLHVGLSSGQRVPAPT

SEQ ID NO: 752620 - protein, 619 aa, Homo sapiens
MYGFVNHALELLVIRNYGPEVWEDIKKEAQLDEEGQFLVRIIYDDSKTYDLVAAASKVLNLNAGEILQMFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 752621 - protein, 619 aa, Homo sapiens; identical to SEQ ID NO: 752620

SEQ ID NO: 752622 - protein, 547 aa, Homo sapiens
MFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 752623 - protein, 553 aa, Homo sapiens
MYGFVNHALELLVIRNYGPEVWEDIKKEAQLDEEGQFLVRIIYDDSKTYDLVAAASKVLNLNAGEILQMFGKMFFVFCQESGYDTILRVLGSNVREFLQVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 752624 - protein, 116 aa, Homo sapiens
MEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 752625 - protein, 105 aa, Homo sapiens
MFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVTNSNGDF

SEQ ID NO: 752626 - protein, 619 aa, Homo sapiens; identical to SEQ ID NO: 752620

SEQ ID NO: 752627 - protein, 586 aa, Homo sapiens
MYGFVNHALELLVIRNYGPEVWEDIKKEAQLDEEGQFLVRIIYDDSKTYDLVAAASKVLNLNAGEILQMFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 752628 - protein, 602 aa, Homo sapiens
MFGKMFFVFCQESGYDTILRVLGSNVREFLQISQWSEGCATCAASLICPLDSDLTRFHILLSQSLLSLRKHCLLVSLSSLLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 752629 - protein, 343 aa, Homo sapiens
MFGKMFFVFCQESGYDTILRVLGSNVREFLQISQWSEGCATCAASLICPLDSDLTRFHILLSQSLLSLRKHCLLVSLSSLLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSGHGTLDQFWPKGRGWFPVNSLLAMDGQRPPNSLS

SEQ ID NO: 752630 - protein, 831 aa, Homo sapiens
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQHSHNHLNSENQTVTSVSTKRNHKCDPEKETVEVSVKSDDKHMHDHNHRLRHHHRLHHHLDHNNTHHFHNDSITPSERGEPSNEPSTETNKTQEQSDVKLPKGKRKKKGRKSNENSEVITPGFPPNHDQGEQYEHNRVHKPDRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 752631 - protein, 831 aa, Homo sapiens; identical to SEQ ID NO: 752630

SEQ ID NO: 752632 - protein, 831 aa, Homo sapiens; identical to SEQ ID NO: 752630

SEQ ID NO: 752633 - protein, 831 aa, Homo sapiens; identical to SEQ ID NO: 752630

SEQ ID NO: 752634 - protein, 381 aa, Homo sapiens
MSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 752635 - protein, 618 aa, Homo sapiens
MKVHMHTKFCLICLLTFIFHHCNHCHEEHDHGPEALHRQHRGMTELEPSKFSKQAADRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 752636 - protein, 106 aa, Homo sapiens [sequence omitted]

SEQ ID NO: 752637 - protein, 108 aa, Homo sapiens
MKSVTGALHLSWKGHTPRLSLLLTRETVNIPKPSTTCTRRQLARAFSTEPSGGEGARFGLASPEHQVPLLAPSSPPCSSGASPRQSPRLPYVGMRGGRVTWARGRGRP

SEQ ID NO: 752638 - protein, 86 aa, Homo sapiens
ETNENKDTTYQNLWDTAQTVLRGKFIALNVHIKKLDISQLNNLTSQLKELENQEKTNLKVSRRQGITKNRAELKEIETPPKYSKDQ

SEQ ID NO: 752639 - protein, 613 aa, Homo sapiens
MCCWPLLLLWGLLPGTAAGGSGRTYPHRTLLDSEGKYWLGWSQRGSQIAFRLQVRTAGYVGFGFSPTGAMASADIVVGGVAHGRPYLQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEEALEAEKPSGIHVFAVLLHAHLAGRGIRLRHFRKGKEMKLLAYDDDFDFNFQEFQYLKEEQTILPGDNLITECRYNTKDRAEMTWGGLSTRSEMCLSYLLYYPRINLTRCASIPDIMEQLQFIGVKEIYRPVTTWPFIIKSPKQYKNLSFMDAMNKFKWTKKEGLSFNKLVLSLPVNVRCSKTDNAEWSIQGMTALPPDIERPYKAEPLVCGTSSSSSLHRDFSINLLVCLLLLSCTLSTKSL

SEQ ID NO: 752640 - protein, 613 aa, Homo sapiens; identical to SEQ ID NO: 752639

SEQ ID NO: 752641 - protein, 545 aa, Homo sapiens
MNSFLSVFRYPDFSFPYFPQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEEALEAEKPSGIHVFAVLLHAHLAGRGIRLRHFRKGKEMKLLAYDDDFDFNFQEFQYLKEEQTILPGDNLITECRYNTKDRAEMTWGGLSTRSEMCLSYLLYYPRINLTRCASIPDIMEQLQFIGVKEIYRPVTTWPFIIKSPKQYKNLSFMDAMNKFKWTKKEGLSFNKLVLSLPVNVRCSKTDNAEWSIQGMTALPPDIERPYKAEPLVCGTSSSSSLHRDFSINLLVCLLLLSCTLSTKSL

SEQ ID NO: 752642 - protein, 613 aa, Homo sapiens; identical to SEQ ID NO: 752639

SEQ ID NO: 752643 - protein, 157 aa, Homo sapiens
MFGIQENIPRGGTTMKEEPLGSGMNPVRSWMHTAGVVDANTASGVGLARAHFEKQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEI

SEQ ID NO: 752644 - protein, 146 aa, Homo sapiens
MFGIQENIPRGGTTMKEEPLGSGMNPVRSWMHTAGVVDANTAQQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEI

SEQ ID NO: 752645 - protein, 369 aa, Homo sapiens
MLLWLLVFSALGIQAWGDSSWNKTQAKQVSEGLQYLFENISQLTEKDVSTTVSRKAWGAEAVGCSIQLTTPVNVLVIHHVPGLECHDQTVCSQRLRELQAHHVHNNSGCDVAYNFLVGDDGRVYEGVGWNIQGVHTQGYNNISLGFAFFGTKKGHSPSPAALSAMENLITYAVQKGHLSSSYVQPLLVKGENCLAPRQKTSLKKACPGVVPRSVWGARETHCPRMTLPAKYGIIIHTAGRTCNISDECRLLVRDIQSFYIDRLKSCDIGYNFLVGQDGAIYEGVGWNVQGSSTPGYDDIALGITFMGTFTGIPPNAAALEAAQDLIQCAMVKGYLTPNYLLVGHSDVARTLSPGQALYNIISTWPHFKH

SEQ ID NO: 752646 - protein, 114 aa, Homo sapiens
MLLWLLVFSALGIQAWGDSSWNKTQAKQVSEGLQYLFENISQLTEKDVSTTVSRKAWGAEAVGCSIQLTTPVNVLVIHHVPGLECHDQTVCSQRLRELQAHHVHNNSGCDVAYK

SEQ ID NO: 752647 - protein, 51 aa, Homo sapiens
MCSLESDGCQRPVKCISDGDRDCSKSSLRKNFPVPGGKSTSHREPKRKSEG

SEQ ID NO: 752648 - protein, 313 aa, Homo sapiens
LRAPPGVPAAVMQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTRSPGAAGLTSRDSSVLDGTDSQTGNDEEAFDFFEEQDQVAEEGPPVQSLKGEDAEESLEEEEALDPLGIMRSKKPKKHRCEGKGLGPAGSEPPHPQGRPGRSLGHSTQNCMVPFSPGLWGQSRSLRAAGAALTLGARAQCVLFPVDMKGREGVGMPCQPEAQPQG

SEQ ID NO: 752649 - protein, 403 aa, Homo sapiens
LRAPPGVPAAVMQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTRSPGAAGLTSRDSSVLDGTDSQTGNDEEAFDFFEEQDQVAEEGPPVQSLKGEDAEESLEEEEALDPLGIMRSKKPKKHPKVAVKAKPSPRLTIFDEEVDPDEGLFGPGRKLSPQDPSEDVSSMDPLKLFDDPDLGGAIPLGDSLLLPAACESGGPTPSLSHRDASKELFRVEEDLDQILNLGAEPKPKPQLKPKPPVAAKPVIPRKPAVPPKAGPAEAVAGQQKPQEQIQAMDEMDILQYIQDHDTPAQAAPSLF

SEQ ID NO: 752650 - protein, 427 aa, Homo sapiens
MEAGVNRTRGVRVVMHVPGGARHSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERHGTQGPVVSTLAGIPLAGLLVLPTGNWPRKVCAKGPSPPRRLGLRKFLSTRSPGAAGLTSRDSSVLDGTDSQTGNDEEAFDFFEEQDQVAEEGPPVQSLKGEDAEESLEEEEALDPLGIMRSKKPKKHPKVAVKAKPSPRLTIFDEEVDPDEGLFGPGRKLSPQDPSEDVSSMDPLKLFDDPDLGGAIPLGDSLLLPAACESGGPTPSLSHRDASKELFRVEEDLDQILNLGAEPKPKPQLKPKPPVAAKPVIPRKPAVPPKAGPAEAVAGQQKPQEQIQAMDEMDILQYIQDHDTPAQAAPSLF

SEQ ID NO: 752651 - protein, 403 aa, Homo sapiens; identical to SEQ ID NO: 752649

SEQ ID NO: 752652 - protein, 329 aa, Homo sapiens
LRAPPGVPAAVMQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTRSPGAAGLTSRDSSVLDGTDSQTGNDEEAFDFFEEQDQVAEEGPPVQSLKGEDAEESLEEEEALDPLGIMRSKKPKKHPKVAVKAKPSPRLTIFDEEVDPDEGLFGPGRKLSPQDPSEDVSSMDPLKLFDDPDLGGAIPLGDSLLLPAACESGGPTPSLSHRDASKELFRYHLSPAALGQL

SEQ ID NO: 752653 - protein, 117 aa, Homo sapiens
GRPGQREAGRGRGDAGTAGSRDCAPRPESPPPSCSPRRCSSPPGEPDPRAPHRTARSPGRPGGEAGGGRRLLGQGPGAGLPSALGGLSGLGPCTALQERWRPRFTDEETEALWRVEN

SEQ ID NO: 752654 - protein, 224 aa, Homo sapiens
LRAPPGVPAAVMQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTRSPGAAGLTSRDSSVLDGTDSQTGNDEEAFDFFEEQDQVAEEGPPVQSLKGEDAEESLEEEEALDPLGIMRLVSCC

SEQ ID NO: 752655 - protein, 324 aa, Homo sapiens
LRAPPGVPAAVMQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTRSPGAAGLTSRDSSVLDGTDSQTGNDEEAFDFFEEQDQVAEEGPPVQSLKGEDAEESLEEEEALDPLGIMRSKKPKKHPKVAVKAKPSPRLTIFDEEVDPDEGLFGPGRKLSPQDPSEDVSSMDPLKLFDDPDLGGAIPLGDSLLLPAACESGGPTPSLSHRDASKELFRQIQKEP

SEQ ID NO: 752656 - protein, 332 aa, Homo sapiens
LRAPPGVPAAVMQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTRSPGAAGLTSRDSSVLDGTDSQTGNDEEAFDFFEEQDQVAEEGPPVQSLKGEDAEESLEEEEALDPLGIMRSKKPKKHPKVAVKAKPSPRLTIFDEEVDPDEGLFGPGRKLSPQDPSEDVSSMDPLKLFDDPDLGGAIPLGDSLLLPAACESGGPTPSLSHRDASKELFRWDHLVAGKQAQGSH

SEQ ID NO: 752657 - protein, 264 aa, Homo sapiens
MAGLRNESEQEPLLGDTPGSREWDILETEEHYKSRWRSIRILYLTMFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAGNVAVVRSYTAGATSLQERTSSMANISMCQALGFILGPVFQTCFTFLGEKGVTWDVIKLQINMYTTPVLLSAFLGILNIILILAILREHRVDDSGRQCEKYKFRKKQVPDEAQVPQGN

SEQ ID NO: 752658 - protein, 162 aa, Homo sapiens
MAGLRNESEQEPLLGDTPGSREWDILETEEHYKSRWRSIRILYLTMFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAGKVVCICLVVSYSHSF

SEQ ID NO: 752659 - protein, 208 aa, Homo sapiens
MMSIWPYLQKIDPTADTSFLGWVIASYSLGQMVASPIFGLWSNYRPRKEPLIVSILISVAANCLYAYLHIPASHNKYYMLVARGLLGIGAGNVAVVRSYTAGATSLQERTSSMANISMCQALGFILGPVFQTCFTFLGEKGVTWDVIKLQINMYTTPVLLSAFLGILNIILILAILREHRVDDSGRQCEKYKFRKKQVPDEAQVPQGN

SEQ ID NO: 752660 - protein, 206 aa, Homo sapiens
MAGLRNESEQEPLLGDTPGSREWDILETEEHYKSRWRSIRILYLTMFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAGNVAVVRSYTAGATSLQERTSSMANISMCQALGFILGPASTDEAQVPQGNIDQVAVVAIN

SEQ ID NO: 752661 - protein, 162 aa, Homo sapiens; identical to SEQ ID NO: 752658

SEQ ID NO: 752662 - protein, 139 aa, Homo sapiens
ARALVPTAWFLGPRHPSRPKAGQKRAPRTGSSGTGNPSRGDQRQSTGPSRGRRRRWVMLRHSPSLWELVEEHVPLRERREVKRILGEAAVDLSLELRAEVGRGKVGHAPGLPHDSGDFPPPAGPWPCRVTPEILSWSPL

SEQ ID NO: 752663 - protein, 139 aa, Homo sapiens; identical to SEQ ID NO: 752662

SEQ ID NO: 752664 - protein, 117 aa, Homo sapiens [sequence omitted]

SEQ ID NO: 752665 - protein, 296 aa, Homo sapiens
ARALVPTAWFLGPRHPSRPKAGQKRAPRTGSSGTGNPSRGDQRQSTGPSRGRRRRWVMLRHSPSLWELVEEHVPLRERREVKRILGEAAVDLSLELRAEVGNSCLDSDIWVLKAWGEQHAESDSDFIASSGHRDLSIIKDQLNVSNIDQVARHLRGLLEEECHTLEREILILQRCLEEEYLRPCHPSEAALEPTLAELKEQKKAMEQELQASVGPSCVSPNHRQRPLGSSTQGLRPPLPLCGVAPLQCCLPAPPLEPYLRPRGQSATHRWGRQLQCSPREGPASTPMSSAAPQAPA

SEQ ID NO: 752666 - protein, 139 aa, Homo sapiens; identical to SEQ ID NO: 752662

SEQ ID NO: 752667 - protein, 139 aa, Homo sapiens; identical to SEQ ID NO: 752662

SEQ ID NO: 752668 - protein, 366 aa, Homo sapiens
ARALVPTAWFLGPRHPSRPKAGQKRAPRTGSSGTGNPSRGDQRQSTGPSRGRRRRWVMLRHSPSLWELVEEHVPLRERREVKRILGEAAVDLSLELRAEVGWRCYGHCSKRLDPLKPPAPAAISDPSSLLAPPPLLKDLLRQELRQLLQGLRHKAICEGRDQAQAWVQYSPRVLHFALEEPRCDLPEQEIFQMRGGGAQSGHRDLSIIKDQLNVSNIDQVARHLRGLLEEECHTLEREILILQRCLEEEYLRPCHPSEAALEPTLAELKEQKKAMEQELQASVGPSCVSPNHRQRPLGSSTQGLRPPLPLCGVAPLQCCLPAPPLEPYLRPRGQSATHRWGRQLQCSPREGPASTPMSSAAPQAPA

SEQ ID NO: 752669 - protein, 243 aa, Homo sapiens
AGFGERCRRARGTSRTLTCGPRSEPGTAASVGHAPALPLAVGAGGGARSAPGATRSEEDSGGGGGGPEPGAAGGGGSGHRDLSIIKDQLNVSNIDQVARHLRGLLEEECHTLEREILILQRCLEEEYLRPCHPSEAALEPTLAELKEQKKAMEQELQASVGPSCVSPNHRQRPLGSSTQGLRPPLPLCGVAPLQCCLPAPPLEPYLRPRGQSATHRWGRQLQCSPREGPASTPMSSAAPQAPA

SEQ ID NO: 752670 - protein, 121 aa, Homo sapiens
MGDTWDAPRGLPSLFLGPSAVAARSRPPYFPRERAPSHENCQRGGGGSRPQSGEQRRRAAGWGVDSALCPASRPPRGVGRVQAATPRRPAAISRPGRRSRFTQLSEEGKAEPAHTPAFLEA

SEQ ID NO: 752671 - protein, 359 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEDTEAQGIFIDLSEDLENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKNCNGGAINCTNVQISDSPFRCTQEEARSLVESVSSSPNKESNEEEQVWHFLGK

SEQ ID NO: 752672 - protein, 315 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKNCNGGAINCTNVQISDSPFRCTQEEARSLVESVSSSPNKESNEEEQVWHFLGK

SEQ ID NO: 752673 - protein, 164 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQVTFLLQW

SEQ ID NO: 752674 - protein, 344 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKNCNGGAINCTNVQISDSPFRCTQEEARSLVESVSSSPNKESNEEEQVWHFLGK

SEQ ID NO: 752675 - protein, 178 aa, Homo sapiens
RAHSRTVIDAMSALLRLLRTGAPAAACLRLGTSAGTGSRRAMALYHTEERGQPCSQNYRLFFNIDDVKKFKPGYLEATLNWFRLYKVPDGKPENQFAFNGEFKNKAFALEVIKSTHQCWKALLMKNCNGGAINCTNVQISDSPFRCTQEEARSLVESVSSSPNKESNEEEQVWHFLGK

SEQ ID NO: 752676 - protein, 241 aa, Homo sapiens [sequence omitted]

SEQ ID NO: 752677 - protein, 183 aa, Homo sapiens
RAHSRTVIDAMSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQTWEDPHENSFLWRSYSCEDPWNFGSY

SEQ ID NO: 752678 - protein, 116 aa, Homo sapiens
MQPSVSTASQESEKPQMMDGLAEVISRDRPRTWSISPSNSPNLRALWGCRARQCPATLAWMADLQQWGTKSLPRHEENEFMKFINGVYKCYKQGAACFHSVWIFLSALFIYCCQFN

SEQ ID NO: 752679 - protein, 618 aa, Homo sapiens
GRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARGRGPGLLEPTDAGGPPRSAPEAASMLAAELRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 752680 - protein, 132 aa, Homo sapiens
PKKYDSGPSLDVNLVRGPSHYCDIACTWFYRGEIGGLSLSPSPERRKPPPPDPATKPKVSWIHGKHSAAAAGRAPSPPPPGSEAAPSPSKRKRTPSDKSAHTVEHGSPRTRDPKRSGTLPRGRTSRWALEGR

SEQ ID NO: 752681 - protein, 509 aa, Homo sapiens
GRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRELSLGRKKAPHRLCGRFSRISMKLPRIPLRRQKLPKVVVAHHDLDNTLNCSFPGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARGRGPGLLEPTDAGGPPRSAPEAASMLAAELRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 752682 - protein, 287 aa, Homo sapiens
CAPCSPRIGLVLVTPSTFVTAGANEGTGWGRVDPWQLCLILPQWPTTTWITHSTAASRGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARGRGPGLLEPTDAGGPPRSAPEAASMLAAELRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 752683 - protein, 618 aa, Homo sapiens; identical to SEQ ID NO: 752679

SEQ ID NO: 752684 - protein, 423 aa, Homo sapiens
MGAGALLVLLVCLLLSLLGCCCACRGKDPTRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARGRGPGLLEPTDAGGPPRSAPEAASMLAAELRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 752685 - protein, 605 aa, Homo sapiens
GRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARGRGPGLLEPTDAGGPPRSAPEAASMLAAELRGKTRSLGRAEVALGAQGPREKPAPPQKAKRSVPPASPARAPPATETPGPEKAATDLPAPETPRKKTPIQKPRDLQGRL

SEQ ID NO: 752686 - protein, 47 aa, Homo sapiens
MERQVGGTLPPGWGKVTHNSSKDDPCDRLTFQGRYLENGRLGTRVGA

SEQ ID NO: 752687 - protein, 452 aa, Homo sapiens
ARSRRRGNRPRTYQCSECGNAFRRRSLLIQHRRLHSGEKPYECKECGKLFMWHTAFLKHQRLHAGEKLEECEKTFSKDEELRKEQRTHQEKKVYWCNQCSRTFQGSSDLIRHQVTHTREKPYECKECGKTQSELRPSETSRIHSGEKPYVCNKCGESFRSSSDLIKHHRVHTGEKPHECSECGKVFSQRSHLVTHQKIHTGEKPYQCTECEKAFRRRSLLIQRRRIHSGEKPYECKECGKLFMWHTAFLKHQRLHAGEKLEECEKTFSKDEELRGEQKIHQEEKAYWCNQCGRAFQGSSDLIGHQVTHTGEKPYECKECGKTFNQSSDLLRHHRIHSGEKPYVCNKCGKSFRGSSDLIRHHRVHTGEKPYECPECWKAFSQNSHLVSHQRIHTREKPFECSNCGKAFSGWTAFLKHQKLHIGKEFEDCKSLQTGPILIGSRNLMNAVKLGKV

SEQ ID NO: 752688 - protein, 87 aa, Homo sapiens
RAGGRGACVHRQARSGAELICLWGEAWGTAGGCRRRVRMTGPSCSRSASWSRRAPFPALSRYSCLFQFPPVGTANGIFPRPRIHRQA

SEQ ID NO: 752689 - protein, 1119 aa, Homo sapiens
MKEWKSKMEISEEKKSARAASEKLQRQITQECELVETSNSEDRLLKHWVSPLKDAMRHLPSQESGIREMHIIPQKAIVGEIGHGCNEGEKILSAGESSHRYEVSGQNFKQKSGLTEHQKIHNINKTYECKECEKTFNRSSNLIIHQRIHTGNKPYVCNECGKDSNQSSNLIIHQRIHTGKKPYICHECGKDFNQSSNLVRHKQIHSGGNPYECKECGKAFKGSSNLVLHQRIHSRGKPYLCNKCGKAFSQSTDLIIHHRIHTGEKPYECYDCGQMFSQSSHLVPHQRIHTGEKPLKCNECEKAFRQHSHLTEHQRLHSGEKPYECHRCGKTFSGRTAFLKHQRLHAGEKIEECEKTFSKDEELREEQRIHQEEKAYWCNQCGRNFQGTSDLIRHQVTHTGEKPYECKECGKTFNQSSDLLRHHRIHSGEKPCVCSKCGKSFRGSSDLIRHHRVHTGEKPYECSECGKAFSQRSHLVTHQKIHTGEKPYQCTECGKAFRRRSLLIQHRRIHSGEKPYECKECGKLFIWRTAFLKHQSLHTGEKLECEKTFSQDEELRGEQKIHQEAKAYWCNQCGRAFQGSSDLIRHQVTHTREKPYECKECGKTFNQSSDLLRHHRIHSGEKPYVCNKCGKSFRGSSDLIKHHRIHTGEKPYECSECGKAFSQRSHLATHQKIHTGEKPYQCSECGNAFRRRSLLIQHRRLHSGEKPYECKECGKLFMWHTAFLKHQRLHAGEKLEECEKTFSKDEELRKEQRTHQEKKVYWCNQCSRTFQGSSDLIRHQVTHQERNHMNVKNVGKLNQSSDLLRHHRIHSGEKPYVCNKCGESFRSSSDLIKHHRVHTGEKPHECSECGKVFSQRSHLVTHQKIHTGEKPYQCTECEKAFRRRSLLIQRRRIHSGEKPYECKECGKLFMWHTAFLKHQRLHAGEKLEECEKTFSKDEELRGEQKIHQEEKAYWCNQCGRAFQGSSDLIGHQVTHTGEKPYECKECGKTFNQSSDLLRHHRIHSGEKPYVCNKCGKSFRGSSDLIRHHRVHTGEKPYECPECWKAFSQNSHLVSHQRIHTREKPFECSNCGKAFSGWTAFLKHQKLHIGKEFEDCKSLQTGPILIGSRNLMNAVKLGKV

SEQ ID NO: 752690 - protein, 258 aa, Homo sapiens
ADDAHKALSDDALVRRAVGESCAGADSAASAAVGVVGPRAALTMTQQGAALQNYNNELVKCERRSRDGEVGRAAGPGSRLAAGCPWTRLAAGIARLSRALRAGGRVSVARALAGSQAPRRALGGGACLWLPRVEGGPPSAAALLPWAHSACPPGPQAYEELCQKREELCRQIQEEEDEKQRLQNEVRQLTEKLARVNENLARKIASRNEFDRTIAETEAAYLKMLESSQTLLSVLKREAGNLTKATASDQKSSGGRDS

SEQ ID NO: 752691 - protein, 117 aa, Homo sapiens
QQGMALQNYNNELVKCIEELCQKREELCRQIQEEEDEKQRLQNEVRQLTEKLARVNENLARKIASRNEFDRTIAETEAAYLKMLESSQTLLSVLKREAGNLTKATASDQKSSGGRDS

SEQ ID NO: 752692 - protein, 137 aa, Homo sapiens
TISPSLRPLLQHSLLLSIAREPPIPDTLLLLSSQMDPGQDAAGGAGGESCPIYHQHSKKGSKRPRAPEDAMGSTSTWIPGSKPLDFRSKQGQPFGLSLLLLRKARKNPETSSPRPSSTSGDRVSPRNFTREEKSELI

SEQ ID NO: 752693 - protein, 511 aa, Homo sapiens
MSYHSFQPGSRCGSQSFSSYSAVMPRMVTHYAVSKGPCRPGGGRGLRALGCLGSRSLCNVGFGRPRVASRCGGTLPGFGYRLGATCGPSACITPVTINESLLVPLALEIDPTVQRVKRDEKEQIKCLNNRFASFINKFLEQKNKLLETKWNFMQQQRCCQTNIEPIFEGYISALRRQLDCVSGDRVRLESELCSLQAALEGYKKKYEEELSLRPCVENEFVALKKDVDTAFLMKADLETNAEALVQEIDFLKSLYEEEICLLQSQISETSVIVKMDNSRELDVDGIIAEIKAQYDDIASRSKAEAEAWYQCRYEELRVTAGNHCDNLRNRKNEILEMNKLIQRLQQETENVKAQRCKLEGAIAEAEQQGEAALNDAKCKLAGLEEALQKAKQDMACLLKEYQEVMNSKLGLDIEIATYRRLLEGEEHRLCEGIGPVNISVSSSKGAFLYEPCGVSTPVLSTGVLRSNGGCSIVGTGELYVPCEPQGLLSCGSGRKSSMTLGAGGSSPSHKH

SEQ ID NO: 752694 - protein, 95 aa, Homo sapiens
EDGHGCLFFPKGWVVQGQVADAKLVLPTGRVLVHCAMGVSRSATLVLAFLMIYENMTLVEAIQTVQAHRNICPNSGFLRQLQVLDNRLGRETGRF

SEQ ID NO: 752695 - protein, 224 aa, Homo sapiens
AQPCSAQAESCPCTHSPIPGPRPCPRMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMIYENMTLVEAIQTVQAHRNICPNSGFLRQLQVLDNRLGRETGRF

SEQ ID NO: 752696 - protein, 198 aa, Homo sapiens
MDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMIYENMTLVEAIQTVQAHRNICPNSGFLRQLQVLDNRLGRETGRF

SEQ ID NO: 752697 - protein, 240 aa, Homo sapiens
MGLCHFATLALILLVLLEALAQADTQKMVEAQRGVGPRACYSIWLLLAPTPPLSHCLQSPQKQHQVCGDRRLKAGSTNCPSEKCTAWARYSHRMDSLQKQDLRRPKIHGAVQASPYQPPTLASLQRLLWVRQAATLNHIDEVWPSLFLGDAYAARDKSKLIQLGITHVVNAAAGRVLVHCAMGVSRSATLVLAFLMIYENMTLVEAIQTVQAHRNICPNSGFLRQLQVLDNRLGRETGRF

SEQ ID NO: 752698 - protein, 502 aa, Homo sapiens
VTTEAEGWAGWPMAETSLPELGGEDKATPCPSILELEELLRAGKSSCSRVDEVWPNLFIGDAATANNRFELWKLGITHVLNAAHKGLYCQGGPDFYGSSVSYLGVPAHDLPDFDISAYFSSAADFIHRALNTPGAKVLVHCVVGVSRSATLVLAYLMLHQRLSLRQAVITVRQHRWVFPNRGFLHQLCRLDQQLRGAGQELRGQSWSLLPAMGLCHFATLALILLVLLEALAQADTQKMVEAQRGVGPRACYSIWLLLAPTPPLSHCLQSPQKQHQVCGDRRLKAGSTNCPSEKCTAWARYSHRMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMIYENMTLVEAIQTVQAHRNICPNSGFLRQLQVLDNRLGRETGRF

SEQ ID NO: 752699 - protein, 451 aa, Homo sapiens
VTTEAEGWAGWPMAETSLPELGGEDKATPCPSILELEELLRAGKSSCSRVDEVWPNLFIGDAATANNRFELWKLGITHVLNAAHKGLYCQGGPDFYGSSVSYLGVPAHDLPDFDISAYFSSAADFIHRALNTPGAKVLVHCVVGVSRSATLVLAYLMLHQRLSLRQAVITVRQHRWVFPNRGFLHQLCRLDQQLRGAGQELRGQSWSLLPAMGLCHFATLALILLVLLEALAQADTQKMVEAQRGVGPRACYSIWLLLAPTPPLSHCLQSPQKQHQVCGDRRLKAGSTNCPSEKCTAWARYSHRMDSLQKQDLRRPKIHGAVQASPYQPPTLASLQRLLWVRQAATLNHIDEVWPSLFLGDAYAARDKSKLIQLGITHVVNAAAGRVLVHCAMGVSRSATLVLAFLMIYENMTLVEAIQTVQAHRNICPNSGFLRQLQVLDNRLGRETGRF

SEQ ID NO: 752700 - protein, 118 aa, Homo sapiens
ARLGPALPGPAALSGGVGIQVARRPAQSTSSLPASRPTPWMRKLKLRGDVTDPRPGISSSGARHKKLLAPHDVNALGPSQEVETREGPTQSWITRKTGSSTPPWSFPVTRGHKHTSAC

SEQ ID NO: 752701 - protein, 122 aa, Homo sapiens
HLLCWLAFYLTKGEGKGKGQERKREKQWTATRQSLASTVLGWNKPTDSRSSLLQPQITLHSPPQLQPLGPSLCPSPSSQASEQWFFSPTMSSQIYQNYSTEVKAAASCLVHLHLQASSIYLS

SEQ ID NO: 752702 - protein, 78 aa, Homo sapiens
MCKVPEGGLVPKSLYWTMEELENEDLKLWTETIYHSASIFKGAPHKILIQIVDASSVTTWNFDMYKGDIVFNIYHSKR

SEQ ID NO: 752703 - protein, 82 aa, Homo sapiens
VRGMITAYQGQPYSKRGRQYELCPTAAKECQDVPLEVWSLLEFSWDSSAPYLEFTVHFLFSRKPSYFSMWGKQGASFSCILL

SEQ ID NO: 752704 - protein, 31 aa, Homo sapiens
LFECRHDSQKTCSLEHFGFQIWDAQPVMQIF

SEQ ID NO: 752705 - protein, 54 aa, Homo sapiens
CGRPAGSLKALSVCLSDCGACRRSKGSVCLSDCGTCRRSKGSVAPCLELRIRCR

SEQ ID NO: 752706 - protein, 88 aa, Homo sapiens
PPARRPQPKEAAPPQGRSRGYCSESHAEPGLGLGLLVLGLPPLRGLPLRRVLLGPRLNRDASFRCLRSRSHTFTPPRAGGEASGRYRY

SEQ ID NO: 752707 - protein, 123 aa, Homo sapiens
YQSFILLLISPFTTCVSEPFLVQAWNSSVSRWPPCLSEYQPVFLVYREWRVPQASGETGPALLGGPPSWVPSPPPRRQRGRLFPLMLVLNLSPYFSPHPLPSPLQYCCLLIRSSPAPIFAMDF

SEQ ID NO: 752708 - protein, 123 aa, Homo sapiens; identical to SEQ ID NO: 752707

SEQ ID NO: 752709 - protein, 92 aa, Homo sapiens
GALGRICGGLRGRSGPVNKGFDYMDIFKRGRPRIVKSSGPHLKTSSWPWAKVSSVPQKALTPRQCLLAPKGKHSPLGTNFLDCFPSPAPTTR

SEQ ID NO: 752710 - protein, 124 aa, Homo sapiens
FGTIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLLAHSDPVSAIHFNRDGFLIVSSSY

SEQ ID NO: 752711 - protein, 120 aa, Homo sapiens
MGLENPWGSQKQSPTDTEGQLYLPARVRATKSTVLLGRLQTGQTFLTLILLLREAWRNIVKPEASLGGVLCVGVREGIHRLITWAGRERPCQGKRPRQQGGRSTPRGRQGGADLRSGATA

SEQ ID NO: 752712 - protein, 1061 aa, Homo sapiens
MSAYSVPSTFAQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 752713 - protein, 139 aa, Homo sapiens
VKLKKMKYSFQLWIAMMSAKGHDGKEPVKFVDLLGDHGKHVSPLWELIKWCLGLSVYTIPSIGLALLEEKLRYSNEKYQKFKAVEESLRKELVDMLGDDGVFLYPSHPTVAPKHHVPLTRPFNFAYTGVCTQRSLGPFI

SEQ ID NO: 752714 - protein, 139 aa, Homo sapiens
WVTRVSSWESSLQGPCSSRWVQFVTSCRGDLRDEVRNLWLKKILHEPPPTCLPLLIRGRFILGHPILEGDATAQLRPGGTELSEQQAPDGLPLAQAVIVTFETEPQLFALADVGELEHLPPFLAFAFAISTATFPGLEE

SEQ ID NO: 752715 - protein, 105 aa, Homo sapiens
MQAKVPGDPGSHLTVPYRPPEGVLELQCCVFLASTLGVPPTPTVQGFQWTLRGTDVETSPFGAPRATSHGVGRMKSCQIPQVARALEQPHKGEGNIFTVVLSLIG

SEQ ID NO: 752716 - protein, 105 aa, Homo sapiens
MQAKVPGDPGSHLTVPYRPPEGVLELQCCVFLASTLGVPPTPTVQGFQWTLRGTDVETSPFGAPRATSHGVGRMKSCQIPQMELFLFSLGSNATAPSQLTATSTS

SEQ ID NO: 752717 - protein, 269 aa, Homo sapiens
MQAKVPGDPGSHLTVPYRPPEGVLELQCCVFLASTLGVPPTPTVQGFQWTLRGTDVETSPFGAPRATSHGVGRMKSCQIPQVARALEQPHKALEDKMVKQNNIIPGETQILVRFTGWESKVNAKKQPPVGIKCEPMDQDGYLARWPQSTSLLSESALLTVLSALSGGTSNLVFVVKDPKVLWGVIIIFDNIPDSTSSATNVSMVVSAGPLSSEKAEMNILEINEKLRPQLAEKKQQFRNLKREMFSNSSGRLPGQRQKKYQYEECKDLI

SEQ ID NO: 752718 - protein, 125 aa, Homo sapiens
ASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 752719 - protein, 794 aa, Homo sapiens
MADAWEEIRRLAADFQRAQFAEATQRLSERNCIEIVNKLIAQKQLEVVHTLDGKEYITPAQISKEMRDELHVRGGRVNIVDLQQVINVDLIHIENRIGDIIKSEKHVQLVLGQLIDENYLDRLAEEVNDKLQESGQVTISELCKTYDLPGNFLTQALTQRLGRIISGHIDLDNRGVIFTEAFVARHKARIRGLFSAITRPTAVNSLISKYGFQEQLLYSVLEELVNSGRLRGTVVGGRQDKAVFVPDIYSRTQSTWVDSFFRQNGYLEFDALSRLGIPDAVSYIKKRYKTTQLLFLKAACVGQGLVDQVEASVEEAISSGTWVDIAPLLPTSLSVEDAAILLQQVMRAFSKQASTVVFSDTVVVSEKFINDCTELFRELMHQKAEKEMKNNPVHLITEEDLKQISTLESVSTSKKDKKDERRRKATEGSGSMRGGGGGNAREYKIKKVKKKGRKDDDSDDESQSSHTGKKKPEISFMFQDEIEDFLRKHIQDAPEEFISELAEYLIKPLNKTYLEVVRSVFMSSTTSASGTGRKRTIKDLQEEVSNLYNNIRLFEKGMKFFADDTQAALTKHLLKSVCTDITNLIFNFLASDLMMAVDDPAAITSEIRKKILSKLSEETKVALTKLHNSLNEKSIEDFISCLDSAAEACDIMVKRGDKKRERQILFQHRQALAEQLKVTEDPALILHLTSVLLFQFSTHSMLHAPGRCVPQIIAFLNSKIPEDQHALLVKYQGLVVKQLVSQSKKTGQGDYPLNNELDKEQEDVASTTRKELQELSSSIKDLVLKSRKSSVTEE

SEQ ID NO: 752720 - protein, 132 aa, Homo sapiens
SSSASTASQAVMADAWEEIRRLAADFQRAQFAEATQRCPTLPLLCGAQIRPWADTPVSGTLDPRPCIPGLLAACHHSLLLPLSRAWIAVPSPRLGGKVLSLGRPGAPQPSCSEMLARPAPPWTGPVISSCLY

SEQ ID NO: 752721 - protein, 794 aa, Homo sapiens; identical to SEQ ID NO: 752719

SEQ ID NO: 752722 - protein, 103 aa, Homo sapiens
CISLQRSLCIEMSGKRDSWMKHLPQFASRWVFGFLDPLTQLPDGHAFENRQLGTLQSPGVFLLRHVSISLKKKMLPTFLHSHQKRNLLTCNENFKKLIQKLSF

SEQ ID NO: 752723 - protein, 107 aa, Homo sapiens
LLSPRLEYSGVILAHCNLCLLGSSDSPASASRVAEITGTGHHTQLIFVVLVETGFHHVGQAALELLTSGDPPASASQRAGITGMSHCAWPELRRNGEKWPLKGPKFP

SEQ ID NO: 752724 - protein, 81 aa, Homo sapiens
LLLRRLSTAQLQLKRSFGPGLSCKKRSSARRTTRSEACGWRRGAWTAAANIEPSSIPCPPYDQQKASHAKNLTAVLRKTSF

SEQ ID NO: 752725 - protein, 96 aa, Homo sapiens
MVVSLYFPTHPDSFPVLLCLVLCPGRLILRDCIPQTPFVIDFCLGLVNGMPWHSFGGKKREDNVFLHCSHSDLGYVLLAGTASLQDFSFFQKSPPP

SEQ ID NO: 752726 - protein, 569 aa, Homo sapiens
MASCSTAAFDKQPQSRERGITLDLGFSCFSVPLPARLRSSLPEFQAAPEAEPEPGEPLLQVTLVDCPGHASLIRTIIGGAQIIDLMMLVIDVTKGMQTQSAECLVIGQIACQKLVVVLNKIDLLPEGKRQAAIDKMTKKMQKTLENTKFRGAPIIPVAAKPGGPEAPETEAPQGIPELIELLTSQISIPTRDPSGPFLMSVDHCFSIKGQGTVMTGTILSGSISLGDSVEIPALKVVKKVKSMQMFHMPITSAMQGDRLGICVTQFDPKLLERGLVCAPESLHTVHAALISVEKIPYFRGPLQTKAKFHITVGHETVMGRLMFFSPAPDNFDQEPILDSFNFSQEYLFQEQYLSKDLTPAVTDNDEADKKAGQATEGHCPRQQWALVEFEKPVTCPRLCLVIGSRLDADIHTNTCRLAFHGILLHGLEDRNYADSFLPRLKVYKLKHKHGLVERAMDDYSVIGRSLFKKETNIQLFVGLKVHLSTGELGIIDSAFGQSGKFKIHIPGGLSPESKKILTPALKKRARAGRGEATRQEESAERSEPSQHVVLSLTFKRYVFDTHKRMVQSP

SEQ ID NO: 752727 - protein, 506 aa, Homo sapiens
DIVDPRAPVRGGGGGMAGRRVNVNVGVLGHIDSGKTALARALSTTASTAAFDKQPQSRERGITLDLGFSCFSVPLPARLRSSLPEFQAAPEAEPEPGEPLLQVTLVDCPGHASLIRTIIGGAQIIDLMMLVIDVTKGMQTQSAECLVIGQIACQKLVVVLNKIDLLPEGKRQAAIDKMTKKMQKTLENTKFRGAPIIPVAAKPGGPEAPETEAPQGIPELIELLTSQISIPTRDPSGPFLMSVDHCFSIKGQGTVMTGTILSGSISLGDSVEIPALKVVKKVKSMQMFHMPITSAMQGDRLGICVTQFDPKLLERGLVCAPESLHTVHAALISVEKIPYFRGPLQTKAKFHITVGHETVMGRLMFFSPAPDNFDQEPILDSFNFSQEYLFQEQYLSKDLTPAVTDNDEADKKAGQATEGHCPRQQWALVEFEKPVTCPRLCLVIGSRLDADIHTNTCRLAFHGILLHGLEDRNYADSFLPRLKVYKLKHKHGLVERVASAPSPRRS

SEQ ID NO: 752728 - protein, 611 aa, Homo sapiens
DIVDPRAPVRGGGGGMAGRRVNVNVGVLGHIDSGKTALARALSTTASTAAFDKQPQSRERGITLDLGFSCFSVPLPARLRSSLPEFQAAPEAEPEPGEPLLQVTLVDCPGHASLIRTIIGGAQIIDLMMLVIDVTKGMQTQSAECLVIGQIACQKLVVVLNKIDLLPEGKRQAAIDKMTKKMQKTLENTKFRGAPIIPVAAKPGGPEAPETEAPQGIPELIELLTSQISIPTRDPSGPFLMSVDHCFSIKGQGTVMTGTILSGSISLGDSVEIPALKVVKKVKSMQMFHMPITSAMQGDRLGICVTQFDPKLLERGLVCAPESLHTVHAALISVEKIPYFRGPLQTKAKFHITVGHETVMGRLMFFSPAPDNFDQEPILDSFNFSQEYLFQEQYLSKDLTPAVTDNDEADKKAGQATEGHCPRQQWALVEFEKPVTCPRLCLVIGSRLDADIHTNTCRLAFHGILLHGLEDRNYADSFLPRLKVYKLKHKHGLVERAMDDYSVIGRSLFKKETNIQLFVGLKVHLSTGELGIIDSAFGQSGKFKIHIPGGLSPESKKILTPALKKRARAGRGEATRQEESAERSEPSQHVVLSLTFKRYVFDTHKRMVQSP

SEQ ID NO: 752729 - protein, 611 aa, Homo sapiens; identical to SEQ ID NO: 752728

SEQ ID NO: 752730 - protein, 556 aa, Homo sapiens
DIVDPRAPVRGGGGGMAGRRVNVNVGVLGHIDSGKTALARALSTTASTAAFDKQPQSRERGITLDLGFSCFSVPLPARLRSSLPEFQAAPEAEPEPGEPLLQVTLVDCPGHASLIRTIIGGAQIIDLMMLVIDVTKGMQTQSAECLVIGQIACQKLVVVLNKIDLLPEGKRQAAIDKMTKKMQKTLENTKFRGAPIIPVAAKPGGPEAPETEAPQGIPELIEVVKKVKSMQMFHMPITSAMQGDRLGICVTQFDPKLLERGLVCAPESLHTVHAALISVEKIPYFRGPLQTKAKFHITVGHETVMGRLMFFSPAPDNFDQEPILDSFNFSQEYLFQEQYLSKDLTPAVTDNDEADKKAGQATEGHCPRQQWALVEFEKPVTCPRLCLVIGSRLDADIHTNTCRLAFHGILLHGLEDRNYADSFLPRLKVYKLKHKHGLVERAMDDYSVIGRSLFKKETNIQLFVGLKVHLSTGELGIIDSAFGQSGKFKIHIPGGLSPESKKILTPALKKRARAGRGEATRQEESAERSEPSQHVVLSLTFKRYVFDTHKRMVQSP

SEQ ID NO: 752731 - protein, 611 aa, Homo sapiens; identical to SEQ ID NO: 752728

SEQ ID NO: 752732 - protein, 674 aa, Homo sapiens
DIVDPRAPVRGGGGGMAGRRVNVNVGVLGHIDSGKTALARALSTTASTAAFDKQPQSRERGITLDLGFSCFSVPLPARLRSSLPEFQAAPEAEPEPGEPLLQVTLVDCPGHASLIRTIIGGAQIIDLMMLVIDVTKGMQTQSAECLVIGQIACQKLVVVLNKIDLLPEGKRQAAIDKMTKKMQKTLENTKFRGAPIIPVAAKPGGPEAPETEAPQGIPELIELLTSQISIPTRDPSGPFLMSVDHCFSIKGQGTVMTGTILSGSISLGDSVEIPALKSLGLVLREGCYPRVERMCVRHLSCAPWTLANVGGVSYSVDGERPSKLARREMTKRKACFSHSEVVKKVKSMQMFHMPITSAMQGDRLGICVTQFDPKLLERGLVCAPESLHTVHAALISVEKIPYFRGPLQTKAKFHITVGHETVMGRLMFFSPAPDNFDQEPILDSFNFSQEYLFQEQYLSKDLTPAVTDNDEADKKAGQATEGHCPRQQWALVEFEKPVTCPRLCLVIGSRLDADIHTNTCRLAFHGILLHGLEDRNYADSFLPRLKVYKLKHKHGLVERAMDDYSVIGRSLFKKETNIQLFVGLKVHLSTGELGIIDSAFGQSGKFKIHIPGGLSPESKKILTPALKKRARAGRGEATRQEESAERSEPSQHVVLSLTFKRYVFDTHKRMVQSP

SEQ ID NO: 752733 - protein, 540 aa, Homo sapiens
DIVDPRAPVRGGGGGMAGRRVNVNVGVLGHIDSGKTALARALSTTASTAAFDKQPQSRERGITLDLGFSCFSVPLPARLRSSLPEFQAAPEAEPEPGEPLLQVTLVDCPGHASLIRTIIGGAQIIDLMMLVIDVTKGMQTQSAECLVIGQIACQKLVVVLNKIDLLPEGKRQAAIDKMTKKMQKTLENTKFRGAPIIPVAAKPGGPEAPETEAPQGIPELIELLTSQISIPTRDPSGPFLMSVDHCFSIKGQGTVMTGTILSGSISLGDSVEIPALKVVKKVKSMQMFHMPITSAMQGDRLGICVTQFDPKLLERGLVCAPESLHTVHAALISVEKIPYFRGPLQTKAKFHITVGHETVMGRLMFFSPAPDNFDQEPILDSFNFSQEYLFQEQYLSKDLTPAVTDNDEADKKAGQATEGHCPRQQWALVEFEKPVTCPRLCLVIGSRLDADIHTNTCRLAFHGILLHGLEDRNYADSFLPRLKVYKLKHKHGLVERAMDDYSVIGRSLLGNWASSTVPSARAASSRSTSQVASAPSPRRS

SEQ ID NO: 752734 - protein, 244 aa, Homo sapiens
MSVVLRLRNPGLNITALMWCLLCARHCFKNFTDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 752735 - protein, 244 aa, Homo sapiens; identical to SEQ ID NO: 752734

SEQ ID NO: 752736 - protein, 344 aa, Homo sapiens
GLRVRGSMADAAPQLGKRKRELDVEEAHAASTEEKEAGVGNGTCAPVRLPFSGFRLQKVLRESARDKIIFLHGKVNEASEDGDGEDAVVILEKTPFQVEQVAQLLTGSPELQLQFSNDIYSTYHLFPPRQLNDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 752737 - protein, 201 aa, Homo sapiens
EDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYDSNSEEALPASGKSKYEAMDFDSLLKEAQQSLH

SEQ ID NO: 752738 - protein, 538 aa, Homo sapiens
MLQIGEDVDYLLIPREVRLAGGVWRVISKPATKEAEFRERLTQFLEEEGRTLEDVARIMEKSTPHPPQPPKKPKEPRVRRRVQQMVTPPPRLVVGTYDSSNASDSEFSDFETSRDKSRQGPRRGKKVRKMPVSYLGSKFLGSDLESEDDEELVEAFLRRQEKQPSAPPARRRVNLPVPMFEDNLGPQLSKADRWREYVSQVSWGKLKRRVKGWAPRAGPGVGEARLASTAVESAGVSSAPEGTSPGDRLGNAGDVCVPQASPRRWRPKINWASFRRRRKEQTAPTGQGADIEADQGGEAADSQREEAIADQREGAAGNQRAGAPADQGAEAADNQREEAADNQRAGAPAEEGAEAADNQREEAADNQRAEAPADQRSQGTDNHREEAADNQRAEAPADQGSEVTDNQREEAVHDQRERAPAVQGADNQRAQARAGQRAEAAHNQRAGAPGIQEAEVSAAQGTTGTAPGARARKQVKTVRFQTPGRFSWFCKRRRAFWHTPRLPTLPKRVPRAGEARNLRVLRAEARAEAEQGEQEDQL

SEQ ID NO: 752739 - protein, 538 aa, Homo sapiens; identical to SEQ ID NO: 752738

SEQ ID NO: 752740 - protein, 538 aa, Homo sapiens; identical to SEQ ID NO: 752738

SEQ ID NO: 752741 - protein, 331 aa, Homo sapiens
MLQIGEDVDYLLIPREVRLAGGVWRVISKPATKEAEFRERLTQFLEEEGRTLEDVARIMEKSTPHPPQPPKKPKEPRVRRRVQQMVTPPPRLVVGTYDSSNASDSEFSDFETSRDKSRQGPRRGKKVRKMPVSYLGSKFLGSDLESEDDEELVEAFLRRQEKQPSAPPARRRVNLPVPMFEDNLGPQLSKADRWREYVSQVSWGKLKRRVKGWAPRAGPGVGEARLASTAVESAGVSSAPEGTSPGDRLGNAGDVCVPQASPRRWRPKINWASFRRRRKEQTAPTGQGADIEADQGGEAADSQREEAIADQREGAAGNQRAGAPADQGAVA

SEQ ID NO: 752742 - protein, 138 aa, Homo sapiens
MLQIGEDVDYLLIPREVRLAGGVWRVISKPATKEAEFRERLTQFLEEEGRTLEDVARIMEKSTPHPPQPPQKAQGAPSEEESAADGDSSALAVRSTPILDDGDTCVYVVTSLAILMPRALLVWRGQGPWFAHLTRSWL

SEQ ID NO: 752743 - protein, 538 aa, Homo sapiens; identical to SEQ ID NO: 752738

SEQ ID NO: 752744 - protein, 232 aa, Homo sapiens; identical to SEQ ID NO: 752373

SEQ ID NO: 752745 - protein, 88 aa, Homo sapiens
MATGSCWSPPAPNFQQNLWNPRSRLVCPGLCRPSSDQLRTLAGSVVLYINSAAAWLSCRDCCLTGDVLASRGPSRWVPRHCRAAHSLL

SEQ ID NO: 752746 - protein, 118 aa, Homo sapiens
QPQPPPQQQHQPPPRPVHLQPMQFSTHIQQPPPPQGQQPPHPPPGQQPPPPQPAKPQQVIQHHHSPRHHKSDPYSTGHLREAPSPLMIHSPQMSQFQSLTHQSPPQQNVQPKKQVTGR

SEQ ID NO: 752747 - protein, 1296 aa, Homo sapiens
MELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRRPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYDEPAPWSSPAAAAPGLPEVGVSLDDGLAPFSPSHPAPPSDPSHQISPGPTWDIKREHDVRKPKELSACGQKKQRLGEQRERSASPQRAARPRLEEAPGGQGRPEAGRPASEARAPGLAAADAADAARAGGKEAPRAAAGSELCRREGPGAAPAFAGPGRRRQRRAGGRGQGGCARGSPAGARDPRGAPRRARPPSRRGPGRCRVLTSCPASSNPAPRPPADEPRGHGQPARPGAGSSS

SEQ ID NO: 752748 - protein, 98 aa, Homo sapiens
AGRLEEDPPLAKLKVFYRILAVNGQSIINMPHADIVKLIKDAGLSVTLRIIPQEGECLRQPCREAANTWTHSPGVLSLPARVAECTCLPSLWCQSVRG

SEQ ID NO: 752749 - protein, 1473 aa, Homo sapiens
MSKSLKKKSHWTSKVHESVIGRNPEGQLGFELKGGAENGQFPYLGEVKPGKVAYESGSKLVSEELLLEVNETPVAGLTIRDVLAVIKHCKDPLRLKCVKQGGIVDKDLRHYLNLRFQKGSVDHELQQIIRDNLYLRTVPCTTRPHKEGEVPGVDYIFITVEDFMELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRQQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYDEPAPWSSPAAAAPGLPEVGVSLDDGLAPFSPSHPAPPSDPSHQISPGPTWDIKREHDVRKPKELSACGQKKQRLGEQRERSASPQRAARPRLEEAPGGQGRPEAGRPASEARAPGLAAADAADAARAGGKEAPRAAAGSELCRREGPGAAPAFAGPGRRRQRRAGGRGQGGCARGSPAGARDPRGAPRRARPPSRRGPGRCRVLTSCPASSNPAPRPPADEPRGHGQPARPGAGSSS

SEQ ID NO: 752750 - protein, 1473 aa, Homo sapiens; identical to SEQ ID NO: 752749

SEQ ID NO: 752751 - protein, 1340 aa, Homo sapiens
MELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRQQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYGMVPSSLSMCMKSDKHGSPYFYLLGHPKDTDEPAPWSSPAAAAPGLPEVGVSLDDGLAPFSPSHPAPPSDPSHQISPGPTWDIKREHDVRKPKELSACGQKKQRLGEQRERSASPQRAARPRLEEAPGGQGRPEAGRPASEARAPGLAAADAADAARAGGKEAPRAAAGSELCRREGPGAAPAFAGPGRRRQRRAGGRGQGGCARGSPAGARDPRGAPRRARPPSRRGPGRCRVLTSCPASSNPAPRPPADEPRGHGQPARPGAGSSS

SEQ ID NO: 752752 - protein, 1473 aa, Homo sapiens; identical to SEQ ID NO: 752749

SEQ ID NO: 752753 - protein, 802 aa, Homo sapiens
MELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRQQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTIIFQSSFSSLQAVEQKRG

SEQ ID NO: 752754 - protein, 104 aa, Homo sapiens
AELLGKMDEARRWYEEALALSPTHVKSMQRLALILHQLGRYSLAEKILRDAVQVNSTAHEVWNGLGEVLQAQGNDAAATECFLTALELEASSPAVPFTIIPRVL

SEQ ID NO: 752755 - protein, 135 aa, Homo sapiens
HNERSYKCNKCDRFFRYRSYIAIHHRTHAGEKPYKCHDCGKVFSQVSSYAKHRRIHTGEKLTSVMIVAKRLLHIHTSIDIRESMLDRNLTNVISVVRSSVRDHSLQTIRQFLLETVVSNAISIASHQALIDITVK

SEQ ID NO: 752756 - protein, 138 aa, Homo sapiens
MCHAHSRVITHVHTGTYSAHAHTLTHCAHTFTHTMHTCNYTHMHTGTHTTHAHTPSHTCAHTFTHTMPTHVITHMHTYAFTCTHMQIHSCLHTVIHMHTHAHTKIYVHTHAHNAFTCTHSYTHSTCPLMQLHVSTHIH

SEQ ID NO: 752757 - protein, 104 aa, Homo sapiens
FPRGSPALQPAHHLPCQPPHRERAGGYREKRGCPEHKGTRPNPFSPQGSSPGDSLSFPQLHCLAPSCPDLSRPRRKYVEARGPLAVSDSRGCLSLHGLVRHCRF

SEQ ID NO: 752758 - protein, 104 aa, Homo sapiens; identical to SEQ ID NO: 752757

SEQ ID NO: 752759 - protein, 455 aa, Homo sapiens
REPDGSALGLTRGLGRCCPGGSAWAGRQPRDTAVPTPSEHPKPDAATPRRGPQGHGRGHPVVQVEPPCVCMTLTSRRQDSQEARPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRSHPGLGCPGPKPAGVQAQQSPLETALPEACCLGSRVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGEGRASVPRSSPVCGV

SEQ ID NO: 752760 - protein, 398 aa, Homo sapiens
MQPPPDEARRDMAGDTQWSRPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRYLLSEKDLILALGVLAQSRPVSRHSRVPWRRLFRKPAVWAAVVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGEGRASVPRSSPVCGV

SEQ ID NO: 752761 - protein, 436 aa, Homo sapiens
MQPPPDEARRDMAGDTQWSRPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRYLLSEKDLILALGVLAQSRPVSRHSRVPWRRLFRKPAVWAAVVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGVVGVCLGGYLMETTGSWTCLFNLVAIISNLGLCTFLVFGQAQRVDLSSTHEDL

SEQ ID NO: 752762 - protein, 132 aa, Homo sapiens
MNYTQRELQMAAPTHLNHTVVGTPCGNQTLATTRRKHLAWRERRPAHTTPARARDGNPNIGVGAADKPPSLLNHARRSSLPNRPPRSTGGDESLITHNPSYSHGRRAILHACVVPHHTERRVASIICRPGPR

SEQ ID NO: 752763 - protein, 113 aa, Homo sapiens
REAGAHVQPEAWTRPADPSGTTPKSPILWQRVAPPALIAISLKPLLPQISSWPWVSWPKAGRCPGTAESPGDGSSGSLLSGQPSSPSSLQPAPSSSSSPGCPPSSRRPSPTPR

SEQ ID NO: 752764 - protein, 411 aa, Homo sapiens
MFPRPGALSWTVRRHTPRQVEPPCVCMTLTSRRQDSQEARPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRSHPGLGCPGPKPAGVQAQQSPLETALPEACCLGSRVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGEGRASVPRSSPVCGV

SEQ ID NO: 752765 - protein, 493 aa, Homo sapiens
REPDGSALGLTRGLGRCCPGGSAWAGRQPRDTAVPTPSEHPKPDAATPRRGPQGHGRGHPVVQVEPPCVCMTLTSRRQDSQEARPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRSHPGLGCPGPKPAGVQAQQSPLETALPEACCLGSRVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGVVGVCLGGYLMETTGSWTCLFNLVAIISNLGLCTFLVFGQAQRVDLSSTHEDL

SEQ ID NO: 752766 - protein, 493 aa, Homo sapiens; identical to SEQ ID NO: 752765

SEQ ID NO: 752767 - protein, 161 aa, Homo sapiens
IHENTLLIFHRYRAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFPLPLGLLCCFPLTLLHFYS

SEQ ID NO: 752768 - protein, 955 aa, Homo sapiens
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEVKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 752769 - protein, 955 aa, Homo sapiens; identical to SEQ ID NO: 752768

SEQ ID NO: 752770 - protein, 955 aa, Homo sapiens; identical to SEQ ID NO: 752768

SEQ ID NO: 752771 - protein, 955 aa, Homo sapiens; identical to SEQ ID NO: 752768

SEQ ID NO: 752772 - protein, 955 aa, Homo sapiens; identical to SEQ ID NO: 752768

SEQ ID NO: 752773 - protein, 955 aa, Homo sapiens; identical to SEQ ID NO: 752768

SEQ ID NO: 752774 - protein, 955 aa, Homo sapiens; identical to SEQ ID NO: 752768

SEQ ID NO: 752775 - protein, 884 aa, Homo sapiens
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEVKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKETLILERENKSMWINFEVFTSVWDQTAWFFVKTGFVCQGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 752776 - protein, 955 aa, Homo sapiens; identical to SEQ ID NO: 752768

SEQ ID NO: 752777 - protein, 955 aa, Homo sapiens; identical to SEQ ID NO: 752768

SEQ ID NO: 752778 - protein, 1087 aa, Homo sapiens
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEVKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKSINFLYDYSAMMFSHLKFALDSTNVSQRTVEICGSAIKKKYGLCQNEWPLELLDPLAPTIYYVRSASAYHGEELHPQYPPVEETGQNGKGQGIVQEGLVLKPQGGCMSQEKPTRLRVRRGHDSASVFLPWGTRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 752779 - protein, 955 aa, Homo sapiens; identical to SEQ ID NO: 752768

SEQ ID NO: 752780 - protein, 955 aa, Homo sapiens; identical to SEQ ID NO: 752768

SEQ ID NO: 752781 - protein, 905 aa, Homo sapiens
RTRGSTHASGERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEVKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 752782 - protein, 936 aa, Homo sapiens
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEDEVKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 752783 - protein, 364 aa, Homo sapiens
PNFRSFNSSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 752784 - protein, 899 aa, Homo sapiens
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEVKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHMTVKRRQYVPHPDSST

SEQ ID NO: 752785 - protein, 201 aa, Homo sapiens
CSATAERMPPGLLRENTKMILLISALILNVVKNIRREILNEVNRENQWIPETPVTQGKGQLKKQRKLIKDQRNRRSIGEQETGPDPPPLPPSHLTPTKQKSTLKRQRKERRAPRALTNQDWGPKTLWVQVKEEVAELEEPFSFEPEEEAGAEATTLGTITTTATTIFKKETGKRSGTQSTHPKARSITCMMTVKAKAVTSG

SEQ ID NO: 752786 - protein, 720 aa, Homo sapiens [sequence omitted]

SEQ ID NO: 752787 - protein, 87 aa, Homo sapiens
PPYQLRPKSKKYYLHDDREGEGSDKWVSRGRGRGAFPRGRGRFMFRKSSTSPKWAHDKFSGEEGEIEDDESGTENREEKDNIQPTTE

SEQ ID NO: 752788 - protein, 708 aa, Homo sapiens
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEVKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKVNC

SEQ ID NO: 752789 - protein, 955 aa, Homo sapiens; identical to SEQ ID NO: 752768

SEQ ID NO: 752790 - protein, 955 aa, Homo sapiens; identical to SEQ ID NO: 752768

SEQ ID NO: 752791 - protein, 886 aa, Homo sapiens
MIYRTLAHRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEVKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 752792 - protein, 568 aa, Homo sapiens
MKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 752793 - protein, 209 aa, Homo sapiens
MVELTALNPRNLNFGLSFDRLRENTKMILLISALILNVVKNIRREILNEVNRENQWIPETPVTQGKGQLKKQRKLIKDQRNRRSIGEQETGPDPPPLPPSHLTPTKQKSTLKRQRKERRAPRALTNQDWGPKTLWVQVKEEVAELEEPFSFEPEEEAGAEATTLGTITTTATTIFKKETGKRSGTQSTHPKARSITCMMTVKAKAVTSG

SEQ ID NO: 752794 - protein, 186 aa, Homo sapiens
MYSVVEANSTEEWMDKWGLEDFVSMMKTCIEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 752795 - protein, 170 aa, Homo sapiens
AAGDNQGDEVKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRQVSHFPCLVVFLSH

SEQ ID NO: 752796 - protein, 346 aa, Homo sapiens
CQPRPDSRQVLVAMVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGLKLSKVVVVGDLYVGKTSLIHRFCKNVFDRDYKATIGVDFEIERFEIAGIPYSLQIWDTAGQEKFKCIASAYYRGAQVIITAFDLTDVQTLEHTRQWLEDALRENEAGSCFIFLVGTKKDLLSGAACEQAEADAVHLAREMQAEYWSVSAKTGENVKAFFSRVAALAFEQSVLQDLERQSSARLQVGDGDLIQMEGSPPETQESKRPSSLGCC

SEQ ID NO: 752797 - protein, 237 aa, Homo sapiens
MVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGLKLSKVVVVGDLYVGKTSLIHRFCKNVFDRDYKATIGVDFEIERFEIAGIPYSLQIWDTAGQEKFKCIASAYYRGAQGEQHATSGLNCMQQRGPCRAPQWESRVLCTGTSFLSSKTH

SEQ ID NO: 752798 - protein, 346 aa, Homo sapiens; identical to SEQ ID NO: 752796

SEQ ID NO: 752799 - protein, 204 aa, Homo sapiens
MENLQSCISLRVCIFSNNFITDIHPLQSCIKLIKLDLHGNQIKSLPNTKFWNGLKNLKLLYLHDNGFAKLKNICVLSACPTLIALTMFDCPVSLKKGYRHVLVNSIWPLKALDHHVISDEEIIQNWHLPERFKACNHRLFFNFCPALRKGTTYEEEINNIKHITSKINAILAHNSPVLIVQRWIRGFLVRKNLRYVLFSLPFEY

SEQ ID NO: 752800 - protein, 158 aa, Homo sapiens [sequence omitted]

SEQ ID NO: 752801 - protein, 108 aa, Homo sapiens
GPVAPSRLQVGDITILVNNAAVVHGKSLMDSDDDALLKSQHINTLGQFWTTKAFLPRMLELQNGHIVCLNSVLALSAIPGAIDYCTSKASAFAFMESLTLVACPCMLV

SEQ ID NO: 752802 - protein, 413 aa, Homo sapiens
MVQAVFPGSAAGARNFLLELSTSGFPLHLFYRPNLRRRFFSPRGEFIFFFFFFFFFSPGALHLGRGDFKSGQVGRLSPPYSVYYLLFGVFFNSCIARPGEFRPLPGSAARRMVWKRLGALVMFPLQMIYLVVKAAVGLVLPAKLRDLSRENVLITGGGRGIGRQLAREFAERGARKIVLWGRTEKCLKETTEEIRQMGTECHYFICDVGNREEVYQTAKAVREKVGDITILVNNAAVVHGKSLMDSDDDALLKSQHINTLGQFWTTKAFLPRMLELQNGHIVCLNSVLALSAIPGAIDYCTSKASAFAFMESLTLGLLDCPGVSATTVLPFHTSTEMFQGMRVRFPNLFPPLKPETVARRTVEAVQLNQALLLLPWTMHALVILKSILPQAALEEIHKFSGTYTCMNTFKGRT

SEQ ID NO: 752803 - protein, 250 aa, Homo sapiens
GTAAAAIRGGARKIVLWGRTEKCLKETTEEIRQMGTECHYFICDVGNREEVYQTAKAVREKVGDITILVNNAAVVHGKSLMDSDDDALLKSQHINTLGQFWTTKAFLPRMLELQNGHIVCLNSVLALSAIPGAIDYCTSKASAFAFMESLTLGLLDCPGVSATTVLPFHTSTEMFQGMRVRFPNLFPPLKPETVARRTVEAVQLNQALLLLPWTMHALVILKSILPQAALEEIHKFSGTYTCMNTFKGRT

SEQ ID NO: 752804 - protein, 129 aa, Homo sapiens
MLEEPRSLGATAPGHTPEHLSIGMLLLGEQDSSCPQRRIRLPLGQSQDLCTGLMGITDPHREAGKQPEATLTLLNISSSVEFIVNCFSSLTSLSSVHRPFPGGSVPRCSASRSKTQLILSLHKLVERQE

SEQ ID NO: 752805 - protein, 302 aa, Homo sapiens
MVWKRLGALVMFPLQMIYLVVKAAVGLVLPAKLRDLSRENVLITGGGRGIGRQLAREFAERGARKIVLWGRTEKCLKETTEEIRQMGTECHYFICDVGNREEVYQTAKAVREKVGDITILVNNAAVVHGKSLMDSDDDALLKSQHINTLGQFWTTKAFLPRMLELQNGHIVCLNSVLALSAIPGAIDYCTSKASAFAFMESLTLGLLDCPGVSATTVLPFHTSTEMFQGMRVRFPNLFPPLKPETVARRTVEAVQLNQALLLLPWTMHALVILKSILPQAALEEIHKFSGTYTCMNTFKGRT

SEQ ID NO: 752806 - protein, 302 aa, Homo sapiens; identical to SEQ ID NO: 752805

SEQ ID NO: 752807 - protein, 169 aa, Homo sapiens
MVWKRLGALVMFPLQMIYLVVKAAVGLVLPAKLRDLSRENVLITGGGRGIGRQLAREFAERGARKIVLWGRTEKCLKETTEEIRQMGTECHYFICDVGNREEVYQTAKAVREKVGDITILVNNAAVVHGKSLMDSDDDALLKSQHINTLGQFWPVFDVLDLRRDISLDR

SEQ ID NO: 752808 - protein, 659 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASASKQALVFQCVGCGAFHLQRLGKASGVPSGRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 752809 - protein, 659 aa, Homo sapiens; identical to SEQ ID NO: 752808

SEQ ID NO: 752810 - protein, 630 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASARAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 752811 - protein, 764 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASARSARGQRAVVDERGDRTLPWGIWGFLRDRASLREELGCRGHAGNSWPLVPPTASRRWCSSVWAAGPSTFSVSAKRQESPAAGEQGGRRRRGVPGFSSLPTNHPSLFRAKFSAACGPPVTPECEHCGQRHQVGLGQGRQRSKRVLKVIVPAHLSPVRPQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 752812 - protein, 568 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASASKQALVFQCVGCGAFHLQRLGKASGVPSGRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPG

SEQ ID NO: 752813 - protein, 670 aa, Homo sapiens
AHPLCQHGGAQVLIRETCTLTNSVFCGYESRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASASKQALVFQCVGCGAFHLQRLGKASGVPSGRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 752814 - protein, 589 aa, Homo sapiens
MAGAGYELSPLSPTRCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASASKQALVFQCVGCGAFHLQRLGKASGVPSGRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 752815 - protein, 73 aa, Homo sapiens
PPPPHHPTNITASTGCVLMDGGAQVLIRETCTLTNSVFCGYESRLGGRRRQRMSHARIVSVAKPHFPLRPGAL

SEQ ID NO: 752816 - protein, 73 aa, Homo sapiens; identical to SEQ ID NO: 752815

SEQ ID NO: 752817 - protein, 106 aa, Homo sapiens
HHVSQAGLKLLTSLPKCWDYRHEPPRPAQAPAVLQHLVSPLPAHRALGGWNVGPQYMPHGTPIMLVRIGWIYAFLTRLVPPAVPQTGTVVILQMKKLRHREGILTC

SEQ ID NO: 752818 - protein, 711 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASARSARGQRAVVDGERRQDLALGDLGLLKGQSQSKGGVGVSWSRWELVATGTPHSKQALVFQCVGCGAFHLQRLGKASGVPSGRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 752819 - protein, 736 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASARSARGQRAVVDERGDRTLPWGIWGFLRDRASLREELGCRGHAGNSWPLVPPTASRRWCSSVWAAGPSTFSVSAKRQESPAAGEQGGRRRRGVPGFSSLPTNHPSLFRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 752820 - protein, 645 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASARSARGQRAVVDERGDRTLPWGIWGFLRDRASLREELGCRGHAGNSWPLVPPTASRRWCSSVWAAGPSTFSVSAKRQESPAAGEQGGRRRRGVPGFSSLPTNHPSLFRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPG

SEQ ID NO: 752821 - protein, 623 aa, Homo sapiens
MENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASASKQALVFQCVGCGAFHLQRLGKASGVPSGRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 752822 - protein, 765 aa, Homo sapiens
MQGSSLWLSLTFRSARVLSRARFFEWQSPGLPNTAAMENGTGPYGEERPREVQETTVTEGAAKIAFPSANEVFYNPVQEFNRDLTSRGQTLAWHRLVGQCGWRGRGMSCPLSPTRCAVITEFARIQLGAKGIQSEWRSRLLVGGGHTSLSPCLGSSAAQIQRGFSHIAGPGFCSFSLSAGISGTIFWRLRGGFSEGTLLFSDLCLWVAAVKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASASKQALVFQCVGCGAFHLQRLGKASGVPSGRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 752823 - protein, 147 aa, Homo sapiens
MKQLFPPPPGTSLTHALGAWRGRERAQAATSLLASSASQFPTAVEDALMSVLTSHCAPSTPAATRAQQTGTRGHIHPACPCQQSCVGASRPPGRPQIFLPLTTALSLEAYAADTCSAADFLHNPSSWGKVWYLNEASFDLYSYHYFW

SEQ ID NO: 752824 - protein, 257 aa, Homo sapiens
MSTSQPGACPCQGAASRPAILYALLSSSLKAVPRPRSRCLCRQHRPVQLCAPHRTCREALDVLAKTVAFLRNLPSFWQLPPQDQRRLLQGCWGPLFLLGLAQDAVTFEVAEAPVPSILKKILLEEPSSSGGSGQLPDRPQPSLAAVQWLQCCLESFWSLELSPKEYACLKGTILFNPDVPGLQAASHIGHLQQEAHWVLCEVLEPWCPAAQGRLTRVLLTASTLKSIPTSLLGDLFFRPIIGDVDIAGLLGDMLLLR

SEQ ID NO: 752825 - protein, 245 aa, Homo sapiens
MGGGYDLNLFASPPDSNFVCSVCHGVLKRPARLPCSHIFCKKCILRWLARQKTCPCCRKEVKRKKVVHMNKLRKTIGRLEVKCKNADAGCIVTCPLAHRKGHQDSCPFELTACPNEGCTSQVPRGTLAEHRQHCQQGSQQRCPLGCGATLDPAERARHNCYRELHNAWSVRQERRRPLLLSLLRRVRWLDQATSVVRRELAELSNFLEEDTALLEGAPQEEAEAAPEGNVGAEVVGEPRANIPCK

SEQ ID NO: 752826 - protein, 77 aa, Homo sapiens
LLKASSLQLLGKKDPGLCRTKPPLFSWGWHPFLWPCGTKQIDSSSEYFLFTLFHMVVSESTLDSPHKGLKNTQVMNK

SEQ ID NO: 752827 - protein, 109 aa, Homo sapiens
STPISSMTVYKCCGNVRKLPLWSKKGKHEIIYPFLANNQEKATKMGNQQPMLLLCLWSGHFFYSFTFLINLLSLYSMDLPQILSCARSKNPLLGSGLGPLSGNSIFYLC

SEQ ID NO: 752828 - protein, 260 aa, Homo sapiens
RRRKRPGDPPAACAAIAVMGASRAQCPRVQVGVGSHAAAKRWLGKLRRKRRWRRAREAGSRDPLPSAPLPDPPAPAESPKELDLGAQRERWETFRKLWGLSCEGAAKVLLDTFEYPGLVHHTGGCHCGAVRFAVWAPADLRVVDCSCRLCRKKQHRHFLVPASRFTLLQGAESIVTYRSNTHPALHSFCSRCGVQSFHAAVSDPRVYGVAPHCLDEGTVRSVVIEEVGGGDPGEEAAKEHKAIHKTSSQSAPACPREQEQ

SEQ ID NO: 752829 - protein, 367 aa, Homo sapiens
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCTVFQTQPVTSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 752830 - protein, 367 aa, Homo sapiens; identical to SEQ ID NO: 752829

SEQ ID NO: 752831 - protein, 367 aa, Homo sapiens; identical to SEQ ID NO: 752829

SEQ ID NO: 752832 - protein, 348 aa, Homo sapiens
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEVAVTCTVFPQPVTSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 752833 - protein, 367 aa, Homo sapiens; identical to SEQ ID NO: 752829

SEQ ID NO: 752834 - protein, 349 aa, Homo sapiens
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCTVFQTQPVTSQPQPEGANEAVPTPVVDPDAPPSPPLGAPGLPPAGSPPDSHVLLAAPPGHQLHRAHYDLRHTFMGVVSLGSPSGEVSHPRPPCPGRIRHFKV

SEQ ID NO: 752835 - protein, 348 aa, Homo sapiens; identical to SEQ ID NO: 752832

SEQ ID NO: 752836 - protein, 367 aa, Homo sapiens; identical to SEQ ID NO: 752829

SEQ ID NO: 752837 - protein, 367 aa, Homo sapiens; identical to SEQ ID NO: 752829

SEQ ID NO: 752838 - protein, 367 aa, Homo sapiens; identical to SEQ ID NO: 752829

SEQ ID NO: 752839 - protein, 144 aa, Homo sapiens [sequence omitted]

SEQ ID NO: 752840 - protein, 367 aa, Homo sapiens; identical to SEQ ID NO: 752829

SEQ ID NO: 752841 - protein, 107 aa, Homo sapiens [sequence omitted]

SEQ ID NO: 752842 - protein, 482 aa, Homo sapiens
RLPGRRPSPAPTPAVPRTSAGGAWCGRALRSWRAAPRTLVGECVRRAGGREAGAGGAGRGSPALRAPGEERGERGARRLQLAMVRPLNPRPLPPVVLMLLLLLPPSPLPLAAGDPLPTESRLMNSCLQARRKCQADPTCSAAYHHLDSCTSSISTPLPSEEPSVPADCLEAAQQLRNSSLIGCMCHRRMKNQVACLDIYWTVHRARSLGNYELDVSPYEDTVTSKPWKMNLSKLNMLKPDSDLCLKFAMLCTLNDKCDRLRKAYGEACSGPHCQRHVCLRQLLTFFEKAAEPHAQGLLLCPCAPNDRGCGERRRNTIAPNCALPPVAPNCLELRRLCFSDPLCRSRLVDFQTHCHPMDILGTCATEQSRCLRAYLGLIGTAMTPNFVSNVNTSVALSCTCRGSGNLQEECEMLEGFFSHNPCLTEAIAAKMRFHSQLFSQDWPHPTFAVMAHQNENPAVRPQPWVPSLFSCTLPLILLLSLW

SEQ ID NO: 752843 - protein, 411 aa, Homo sapiens
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 752844 - protein, 441 aa, Homo sapiens [sequence omitted]

SEQ ID NO: 752845 - protein, 411 aa, Homo sapiens; identical to SEQ ID NO: 752843

SEQ ID NO: 752846 - protein, 279 aa, Homo sapiens
MEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 752847 - protein, 402 aa, Homo sapiens
MPMWNKVSGVHLSPSSPEIVLDRDHSSSIGCLSSDAIISSPENTHAANSIIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 752848 - protein, 411 aa, Homo sapiens; identical to SEQ ID NO: 752843

SEQ ID NO: 752849 - protein, 405 aa, Homo sapiens
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQPRLTTGN

SEQ ID NO: 752850 - protein, 421 aa, Homo sapiens
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQDTEGLLVRWQKRDMATRISLSRP

SEQ ID NO: 752851 - protein, 405 aa, Homo sapiens; identical to SEQ ID NO: 752849

SEQ ID NO: 752852 - protein, 379 aa, Homo sapiens
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRSEKAVEEAVKRTRDELIEYIKEQKRVSIS

SEQ ID NO: 752853 - protein, 208 aa, Homo sapiens
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKGFWGSKPGTYPGWASWWKAKASGLLKKEQSILSDSPDFETYGCGCEGSTRLGDMAWVPKQAL

SEQ ID NO: 752854 - protein, 279 aa, Homo sapiens; identical to SEQ ID NO: 752846

SEQ ID NO: 752855 - protein, 441 aa, Homo sapiens [sequence omitted]

SEQ ID NO: 752856 - protein, 237 aa, Homo sapiens
MIVSFLRPPQPCKPALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 752857 - protein, 411 aa, Homo sapiens; identical to SEQ ID NO: 752843

SEQ ID NO: 752858 - protein, 402 aa, Homo sapiens
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQRSLA

SEQ ID NO: 752859 - protein, 405 aa, Homo sapiens; identical to SEQ ID NO: 752849

SEQ ID NO: 752860 - protein, 417 aa, Homo sapiens
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRRKKGKEIKKALVSAAKLEKEAMKDAVLKVVEEERKNLEKAHAEERELWKTEHAKDQEKVSQEIQKAI

SEQ ID NO: 752861 - protein, 342 aa, Homo sapiens
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 752862 - protein, 342 aa, Homo sapiens; identical to SEQ ID NO: 752861

SEQ ID NO: 752863 - protein, 324 aa, Homo sapiens [sequence omitted]

SEQ ID NO: 752864 - protein, 212 aa, Homo sapiens
MFCGDYVQGTIFPAPNFNPIMDAQMLGGALQGFDCDKDMLINILTQRCNAQRMMIAEAYQSMYGRDLIGDLREQLSDHFKDVMAGLMYPPPLYDAHELWHAMKGVGTDENCLIEILASRTNGEIFQMREAYCLQYSNNLQEDIYSETSGHFRDTLMNLVQGTREEGYTDPAMAAQDAMVLWEACQQKTGEHKTMLQMILCNKSYQQLRLGNY

SEQ ID NO: 752865 - protein, 324 aa, Homo sapiens [sequence omitted]

SEQ ID NO: 752866 - protein, 171 aa, Homo sapiens
MDAPANGNANEENGEQEADNEVDEEEEEGGEEEAGGRTKVMVQEEAWQMQDEEAESATGKRAACKMMRMTHVDTKKQKTDEAMTRQQTKEKLNKQKKKAGGDLFQPSKFPVSRILNTGGPATESQEALPGQHGGTAGPCTSTQPHSTHTNAHHGHNFAPGHATQATTNIQA

SEQ ID NO: 752867 - protein, 105 aa, Homo sapiens
TLRTVRPGLSEAPLPPLQKKRRRGLFHFRRPRSFKGDRGPGSPTTGLLLPPPPPPPPTQESPPSPDPPSLGNNSSPCWSPEEESSLLPGFGGGRGPSFRRKMVSE

SEQ ID NO: 752868 - protein, 248 aa, Homo sapiens
GPSFRRKMGTEGSEPGEGGPAPGTAQQPRVHGVALPGLERAKGWSFDGKREGPGPDQEGSTQAWQKRRSSDDAGPGSWKPPPPPQSTKPSFSAMRRAEATWHIAEESAPNHSCQSPSPASQDGEEEKEGTLFPERTLPARNAKLQDPALAPWPPKPVAVPRGRQPPQEPGVREEAEAGDAAPGVNKPRLRLSSQQDQEEPEVQGPPDPGRRTAPLKPKRTRRAQSCDKLEPDRRRPPDPTGTSEPGTD

SEQ ID NO: 752869 - protein, 142 aa, Homo sapiens
MQLASHEEKQNLGYHPLEDGGMTVSRRICSIRCWEGISTDEETEEQRGWKCNGTISAHCNLCLPGSSNSPASASQVAEITDEKTEAQEGSNLPKGAECIREKAKLKLVLPLLFHILPEDLPPMRAGRACIFQTLYLGLPSCH

SEQ ID NO: 752870 - protein, 53 aa, Homo sapiens
MEIKEEGASEEGQHFLPTAQANDPGDCQFTSIQKTPNEPQLEFILDLNQELRD

SEQ ID NO: 752871 - protein, 924 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRREGCRIENVLKNIKCRKYAFNMLQLMAFPKYYRPPEGTYGKADT

SEQ ID NO: 752872 - protein, 924 aa, Homo sapiens; identical to SEQ ID NO: 752871

SEQ ID NO: 752873 - protein, 877 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRRFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRREGCRIENVLKNIKCRKYAFNMLQLMAFPKYYRPPEGTYGKADT

SEQ ID NO: 752874 - protein, 821 aa, Homo sapiens
MSAGWLAKCKTSHELLDSCTMVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRREGCRIENVLKNIKCRKYAFNMLQLMAFPKYYRPPEGTYGKADT

SEQ ID NO: 752875 - protein, 476 aa, Homo sapiens
MLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRREGCRIENVLKNIKCRKYAFNMLQLMAFPKYYRPPEGTYGKADT

SEQ ID NO: 752876 - protein, 546 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIQKD

SEQ ID NO: 752877 - protein, 131 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTIANSSRI

SEQ ID NO: 752878 - protein, 924 aa, Homo sapiens; identical to SEQ ID NO: 752871

SEQ ID NO: 752879 - protein, 938 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRSRQTQGALNESDDPETGCLTDNKPTSRHFYPVALLLVSSHLLVVWLILSLALLLAKYQ

SEQ ID NO: 752880 - protein, 911 aa, Homo sapiens
SAVAKFTFSPAQKFSLRYGVQFLFFLSPLPLPACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRREGCRIENVLKNIKCRKYAFNMLQLMAFPKYYRPPEGTYGKADT

SEQ ID NO: 752881 - protein, 820 aa, Homo sapiens
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAESGDVSFASKDYMRGHFEPPLDSTTYVIGKMPVEDICDDFQALTDLRILSQYIILRINPMPRG

SEQ ID NO: 752882 - protein, 123 aa, Homo sapiens
MGKDQILCPTQDRSSINVCPHLFLLTVPSATPKLISAPPVLGFPCLCSWPSPHLLVPSPFILQAQLKAFPSLGRLPRLPSWDDGSFLETLHQHCQPPSSSTYHTLYESIAYLFLCTSLICLIK

SEQ ID NO: 752883 - protein, 117 aa, Homo sapiens
QSCSRTPEDRKPLGPNLSGAPYTRVPAGLKLDLLNFFFFLRQSLSLLPTLECSGAISAHCNLRLPGSSNSPASASGVAEDHRWMVLPSPFSPKSIHPSSPAQSLPFSRKASQITQLG

SEQ ID NO: 752884 - protein, 127 aa, Homo sapiens
MWKSRSDPVLHIDLRRWADLLLVAPLDANTLGKVASGICDNLLTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 752885 - protein, 252 aa, Homo sapiens
SQIPRESGRDTAIFGSGPETRLARILNPDSFIEPRPGRLPELEATRPHMEPKASCPAAAPLMERKFHVLVGVTGSVAALKLPLLVSKLLDIPGLEVAVVTTERAKHFYSPQDIPVTLYSDADEWEMWKSRSDPVLHIDLRRWADLLLVAPLDANTLGKVASGICDNLLTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 752886 - protein, 177 aa, Homo sapiens
MRLAAKEGSPLSSQPVKTAPACPDPPVASRPVALPQDIPVTLYSDADEWEMWKSRSDPVLHIDLRRWADLLLVAPLDANTLGKVASGICDNLLTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 752887 - protein, 252 aa, Homo sapiens; identical to SEQ ID NO: 752885

SEQ ID NO: 752888 - protein, 236 aa, Homo sapiens
SQIPRESGRDTAIFGSGPETRLARILNPDSFIEPRPGRLPELEATRPHMEPKASCPAAAPLMERKFHVLVGVTGSVAALKLPLLVSKLLDIPGLEVAVVTTERAKHFYSPQDIPVTLYSDADEWEMWKSRSDPVLHIDLRRWADLLLVAPLDANTLGKVASGICDNLLVSDVLVPSSVPGPHTQFAELQTSLYKETCCCGAPVCPGRSCSAIPHIAPSALTFSVAHGHSPGPDGSV

SEQ ID NO: 752889 - protein, 177 aa, Homo sapiens
SQIPRESGRDTAIFGSGPETRLARILNPDSFIEPRPGRLPELEATRPHMEPKASCPAAAPLMERKFHVLVGVTGSVAALKLPLLVSKLLDIPGTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 752890 - protein, 247 aa, Homo sapiens
AALGSILRIQARAHGSWWSESRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 752891 - protein, 80 aa, Homo sapiens
HQDLAEAGSNLETSKAGLEHLPPAEQAKARLQLVLEAAAKADEALKAKERNEEEAKRRKEEDQATLCRSRKQAGSGRSSE

SEQ ID NO: 752892 - protein, 127 aa, Homo sapiens
MKPEADKIVSLVHILMIEDAGIDQAVALLMAPEGNEVEVVQGVEGNPIEFRGLGQKAEQEGPGQDLVSVLIVVAVKGPVTEERVVGLGIENDVRAEIKRKEKRRRIKGRTRNYITSNVGNLETSKLD

SEQ ID NO: 752893 - protein, 344 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRLRKLRLEKIRSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 752894 - protein, 360 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGFHQKNCERKKKLTSNRKKKSFRKTKLESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 752895 - protein, 340 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGLECRYRARFA

SEQ ID NO: 752896 - protein, 314 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSGGRRKEIKILTLILISFLLSFGCMFYYLKNCSRRTVYGVSFFLLLLLSSSVSDDQRPMFF

SEQ ID NO: 752897 - protein, 334 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 752898 - protein, 276 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 752899 - protein, 334 aa, Homo sapiens; identical to SEQ ID NO: 752897

SEQ ID NO: 752900 - protein, 260 aa, Homo sapiens
DAWVDPRVGRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 752901 - protein, 245 aa, Homo sapiens
AGGRKGELFLGKLRGSPLSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 752902 - protein, 164 aa, Homo sapiens
MFYEQIFPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 752903 - protein, 213 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLMGVLLSLPGRRAVVQSWLTAASTSQVQVILLSQPPE

SEQ ID NO: 752904 - protein, 281 aa, Homo sapiens
RPPGGALYSWETGDDRFLFRNFHTGIWYSCEEELSGLGEKCRSFIDLAPASEKGVLWLSVVSEVLYILLLVVGFSLMCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERWQIEAQRGRATCAQLTQLDGEEGRERGGLHLRLQQERYPAETSHNMADSWPGGSDQEAPELTESAGSEGTGVTKPQAGREPQH

SEQ ID NO: 752905 - protein, 329 aa, Homo sapiens
RPPGGALYSWETGDDRFLFRNFHTGIWYSCEEELSGLGEKCRSFIDLAPASEKGVLWLSVVSEVLYILLLVVGFSLMCLELFHSSNVIDGLKLNAFAAVFTVLSVEDSTLVFPQPPGPLCLSFLCWSLLLCLISDVGFILGPFSLLFLQSPPGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERWQIEAQRGRATCAQLTQLDGEEGRERGGLHLRLQQERYPAETSHNMADSWPGGSDRKHQSVTESAGSEGTGVTKPQAGREPQH

SEQ ID NO: 752906 - protein, 226 aa, Homo sapiens
AAESVSSAMMRGSPCQHQQGLETQREEHQHLRGVLWLSVVSEVLYILLLVVGFSLMCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERMEKRDGSEEDFTLRLQQERYPAETSHNMADSWPGGSDQEAPELNDKCWV

SEQ ID NO: 752907 - protein, 130 aa, Homo sapiens
MRFSVSGMRTDYPRSVLAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 752908 - protein, 116 aa, Homo sapiens
RQSFTLVAQARVQWPFSAHRNLHLPGLSNSPASASLVAGIIGKRHHAWPKILFLAYSPEMFFYICIACAFSYWYSLRKIVPLLKEIKKSNHLLKSLFGERDKVLLCCPGWSAVALL

SEQ ID NO: 752909 - protein, 135 aa, Homo sapiens
MAEKFDHLEEHLEKFVENIRQLGIIVSDFQPSSQAGLNQKLNFIVTGLQDIDKCRQQLHDITVPLEVFEYIDQGRNPQLYTKECLERALAKNEQVKGKIDTMKKFKSLLIQELSKVFPEDMAKYRSIRGEDHPPS

SEQ ID NO: 752910 - protein, 135 aa, Homo sapiens; identical to SEQ ID NO: 752909

SEQ ID NO: 752911 - protein, 103 aa, Homo sapiens
MAEKFDHLEEHLEKFVENIRQLGIIVSDFQPSSQAGLNQKLNFIVTGLQDIDKCRQQLHDITVPLEVFEVSNILDISLGYKSCSVMVWYRDFFITGIRVPAVW

SEQ ID NO: 752912 - protein, 135 aa, Homo sapiens; identical to SEQ ID NO: 752909

SEQ ID NO: 752913 - protein, 135 aa, Homo sapiens; identical to SEQ ID NO: 752909

SEQ ID NO: 752914 - protein, 135 aa, Homo sapiens; identical to SEQ ID NO: 752909

SEQ ID NO: 752915 - protein, 71 aa, Homo sapiens
FPFSSEMAVLLSWMKASAAASLNAEHAGFAVPGRKPLKTLTPVSPAERLSLPAPFLTAHGAESVTKEKRAE

SEQ ID NO: 752916 - protein, 94 aa, Homo sapiens
MESSSNEIKRNHQMESNGIIIEWIRIESLNEIEWKQHEMESKGIIEWYRMESSWNGMEWNGMEWNQHRMESKAIIQWTLIESSNRLECNHHRME

SEQ ID NO: 752917 - protein, 176 aa, Homo sapiens
MTMCSGARLALLVYGIIMHSSVYSSPAAAGLRFPGIRPEEEAYGEDGNPLPDFGGSEPPGAGSPASAPRAAAAWYRPAGRRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 752918 - protein, 170 aa, Homo sapiens
THTPHLPLLEPGLAPDPSSCSRDHPGSYWRVLGLWRFPCQPPRPPRGRAPNKGVSSGHLGTETVTLGAHFASPSRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 752919 - protein, 170 aa, Homo sapiens; identical to SEQ ID NO: 752918

SEQ ID NO: 752920 - protein, 74 aa, Homo sapiens
VLAFSWELSCWRVVLFHGASPHGWCWLLTACWFQGHQKSYKVADFPQGTKADGAKPSKCVITDIPECHVHHIVS

SEQ ID NO: 752921 - protein, 119 aa, Homo sapiens
LLLNDPCHQSSPFRLHGSCRIVFLLVWDNNTQNQHIIPPWLCQVAGTFLVTGSLRDVLKCSVTPLRDKRDYSASVRPAEVAYWQMGLAAAAQPLNKDCRLNAYRGQAKAEEGSKVDMKQ

SEQ ID NO: 752922 - protein, 127 aa, Homo sapiens
VAGEVVVLVSLSHPVPSSSLQQTHALAAAMTEQMTLRGTLKGHNGWVTQIATTPQFPDMILSASRDKTIIMWKTGPGDEDQLWGISTGVALAGVHFPFCLGDVGLFSFRGQFLPFSGWGGGTLAAFG

SEQ ID NO: 752923 - protein, 111 aa, Homo sapiens
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTPVSPTG

SEQ ID NO: 752924 - protein, 631 aa, Homo sapiens
MIKEIITRRKIQTANYEKKHVCTTKQITKMKDVYNHRIGTNVPVILIKVNLSVDKRQKCQQTLISCYKIQKELSKSKPSKHKQENELYVCISGKVELREKEPEKKKTKKNHDIMLKGVTHEIMFLDICVPNNGKPFMYWKPEETQEETNTMLVGYFNSILSIHDRSSGEKTRTWDDLNKIQKIYLMHIRLYPKSGNYTSKYPGNISPFDCVLERTENISFRTEKRNNRWHLLMKNAINLEFEDRWSEKKINKLKPENTAHLQSKMFLSSSTILGLIRKCKVLKKHFISKIYTCSSEIQINSAQRKIHCPKIYVLKNKINVIITQNIEEKESFKGRLKESRKINEKNEETKLIFKICSKICNILANITREDKHKIRITKYGIGKSHKIFFAQLYANNLKTWIKWIIFQEGIVCQKMTSKEIKYNNCHRRNEVSISIQHDRLNTFKDPMKTKKCIWRINRNFLEHQFFILHFKAWNGIYCKDSVFYRIQAKAHQPEDKVRPAQENVSSGDLFPLVFHVSLTQSPLFTFSGALDPKPFLKKIILDLTENLQKIDFLCALLSASSNVNLHTNGTIIETRKLTLAQSYYYILYLNCSCFPSNVVFLVRYSIQDPYVLGSFWVFCSTGLLVHGTTLF

SEQ ID NO: 752925 - protein, 101 aa, Homo sapiens
YLLSLLVSVTISYCCLHLKHTHTHTHNHKKPVVSKNINFSCSCRVPLISARLPGVTWVSLILFLRAGPGMSANIPLVKTSHMLNPGYGKLCFALGGRTSQS

SEQ ID NO: 752926 - protein, 89 aa, Homo sapiens
QQRVASEGSHCHLRQPKQQDKPAPPDPPTFSFVGLSGKNKTKTKCRKSKSSFLSCQSPVSFCSVCALVKSRSSSVRCPHSAASAKSHKV

SEQ ID NO: 752927 - protein, 391 aa, Homo sapiens
RVGMVRDSMAAAFRPSNRVLLQALQILVYPGVGGSGSVSCRCPLGAKRYLLTDNVVKLKEFQQKKVAVACNLSGTKETYFRNLKKKLTQNKLILKGELITLLHLCESRDHVELAKNVIYRYHAENKNFTLGEYKFGPLFVRLCYELDLEESAVELMKDQHLRGFFSDSTSFNILMDMLFIKGKYKSALQVLIEMKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVSRRTFQPLSQSLLAE

SEQ ID NO: 752928 - protein, 215 aa, Homo sapiens
MLFIKGKYKSALQVLIEMKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVSRRTFQPLSQSLLAE

SEQ ID NO: 752929 - protein, 236 aa, Homo sapiens
MKDQHLRGFFSDSTSFNILMDMLFIKGKYKSALQVLIEMKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVSRRTFQPLSQSLLAE

SEQ ID NO: 752930 - protein, 391 aa, Homo sapiens; identical to SEQ ID NO: 752927

SEQ ID NO: 752931 - protein, 391 aa, Homo sapiens; identical to SEQ ID NO: 752927

SEQ ID NO: 752932 - protein, 164 aa, Homo sapiens
RVGMVRDSMAAAFRPSNRVLLQALQILVYPGVGGSGSVSCRCPLGAKRYLLTDNVVKLKEFQQKKVAVACNLSGTKETYFRNLKKKLTQNKLILKGELITLLHLCESRDHVELAKNVIYRYHAENKNFTLGEYKFGPLFVRLCYELDLEESAVELMKDQVLCKY

SEQ ID NO: 752933 - protein, 236 aa, Homo sapiens; identical to SEQ ID NO: 752929

SEQ ID NO: 752934 - protein, 365 aa, Homo sapiens
SEYMGNGDFLPTRLQAQQDAVNTVCHSKTRSNPENNVGLITLDNDCEVLTTLTPDTGRILSKLHTVQPKGKITFCMGIHVAHLALKHRQGNNHKIRIIAFVGNPVEDNEKNLVKLAKCLKKEKVNVDIINFGEEEVNTEKLTAFVNTLNGKDGTGSHLVTVPPGPSLADALISFPILAGEGGAMMGLGASDFEFGVDPSADPELALVLRVFMEEQRQRQEEEARQAAAASAAEAGIATTGTEDSDDALLKMTISQQEFGHTGLPDLSSMTEEEKIVCAMQMSLQGAEFGLAESADIDASSAMDTSEPAKEEDDYDVMQDPEFLQSVLENLPGVDPNNEAIRNAVGSLASQATKDSKKDKKEEDKK

SEQ ID NO: 752935 - protein, 115 aa, Homo sapiens
IVPATWEAEVGESLEPRRRRLQRAEIAPLHSSLGNRARLHLKKKKWDTCLHEEVKGVGIKWKAEEPLLWWAGNSTPATPSLPHISSEPFVKDGRTMELGEGAITCLQCQQREANF

SEQ ID NO: 752936 - protein, 473 aa, Homo sapiens
MEEQQPEPKSQRDSALGAAAAATPGGLSLSLSPGASGSSGSGSDGDSVPVSPQPAPPSPPAAPCLPPLAHHPHLPPHPPPPPPQHLAAPAHQPQPAAQLHRTTNFFIDNILRPDFGCKKEQPPPQLLVAAAARGGAGGGGRVERDRGQTAAGRDPVHPLGTRAPGAASLLCAPDANCGPPDGSQPAAAGAGASKAGNPAAAAAAAAAAVAAAAAAAAAKPSDTGGGGSGGGAGSPGAQGTKYPEHGNPAILLMGSANGGPVVKTDSQQPLVWPAWVYCTRYSDRPSSGPRTRKLKKKKNEKEDKRPRTAFTAEQLQRLKAEFQANRYITEQRRQTLAQELSLNESQIKIWFQNKRAKIKKATGIKNGLALHLMAQGLYNHSTTTVQDKDESEYAATGRGRARAPSRHRRRRLPAPRWGRKHLLQGGRERREKSERDRKRASEWTMTLKRSIFEKGERLGQVLSKNKIHSLFPV

SEQ ID NO: 752937 - protein, 142 aa, Homo sapiens
MGSANGGPVVKTDSQQPLVWPAWVYCTRYSDRPSSGPRTRKLKKKKNEKEDKRPRTAFTAEQLQRLKAEFQANRYITEQRRQTLAQELSLNESQIKIWFQNKRAKIKKATASAPRREGAQGKERERQKESLRMDNDVETQHF

SEQ ID NO: 752938 - protein, 105 aa, Homo sapiens
MEENRRLEHQKKQEKANRIVAEAIARARARGEQNIPRVLNEDELPSVRPEEEGEKKRRKKSAGERLKEEKPKKSKTSGASKTKGKSKLNVSTPCYCDGTCKSKLK

SEQ ID NO: 752939 - protein, 45 aa, Homo sapiens
TCAHLQGFQLIGVEVHVRVKDGPVLSVPHQGRQSPSLLRAPQRDW

SEQ ID NO: 752940 - protein, 134 aa, Homo sapiens
TGQPGRVSLKEGDTWLVARSLYYQRLLSNPSIEPWGKLRLGGEAGVHPRPQRSEAGPASHLQSWTPRSHTGDCRKRGGRAGAQPQLHRKSARLHPGASRQGKLPSPQPAGQAPETAPLGFCHNLSRKTGKLSWA

SEQ ID NO: 752941 - protein, 612 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752942 - protein, 612 aa, Homo sapiens; identical to SEQ ID NO: 752941

SEQ ID NO: 752943 - protein, 612 aa, Homo sapiens; identical to SEQ ID NO: 752941

SEQ ID NO: 752944 - protein, 640 aa, Homo sapiens
RRAAWQFLLTSPPGPALGRKGGETWVTNMSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752945 - protein, 632 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752946 - protein, 553 aa, Homo sapiens
RRYRNQYIHHCEEQQSVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752947 - protein, 499 aa, Homo sapiens
MAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752948 - protein, 453 aa, Homo sapiens
GTRWHEALKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752949 - protein, 199 aa, Homo sapiens
MSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGIRSYSWLPITTMKMPLMSLMVWPLYGI

SEQ ID NO: 752950 - protein, 400 aa, Homo sapiens
DKSSTCMYLSFSVLPISPTIVKEDIYPVRESSSNNSRRMVKARVVSCLDWSSYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752951 - protein, 612 aa, Homo sapiens; identical to SEQ ID NO: 752941

SEQ ID NO: 752952 - protein, 612 aa, Homo sapiens; identical to SEQ ID NO: 752941

SEQ ID NO: 752953 - protein, 265 aa, Homo sapiens
CSNNIYTIHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752954 - protein, 504 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKANNKPLYSFEDNADYVYDVMWSPTHPALFACVDGMGRLDLWNLNNDTEVPTASISVEGNPALNRVRWTHSGREIAVGDSEGQIVIYDVGEHIAFPPNDDW

SEQ ID NO: 752955 - protein, 244 aa, Homo sapiens
MSDKSELKAELERKKQRLAQIREEKKRKEEERKKKETDQKKEAVAPVQEESDLEKKRREAEALLQSMGLTPESPIAEQPLRVVTADTVYFTIEFPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKVSPLLACWGKKIPNFFTFGEILKIFFPNLQ

SEQ ID NO: 752956 - protein, 612 aa, Homo sapiens; identical to SEQ ID NO: 752941

SEQ ID NO: 752957 - protein, 612 aa, Homo sapiens; identical to SEQ ID NO: 752941

SEQ ID NO: 752958 - protein, 553 aa, Homo sapiens
MSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752959 - protein, 630 aa, Homo sapiens
MSDKSELKAELERKKQRLAQIREEKKRKEEERKKKETDQKKEAVAPVQEESDLEKKRREAEALLQSMGLTPESPIAEQPLRVVTADTVYFTIWFPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752960 - protein, 431 aa, Homo sapiens
RARSLCLTHLHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 752961 - protein, 321 aa, Homo sapiens [sequence omitted]

SEQ ID NO: 752962 - protein, 480 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFGLGP

SEQ ID NO: 752963 - protein, 377 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHISTGREL

SEQ ID NO: 752964 - protein, 224 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFCHSSFD

SEQ ID NO: 752965 - protein, 70 aa, Homo sapiens
PVASSGNQNRSGSLLFATKCFAQRKTRFHLALGSKLGLEGGGVKPGQAKGDLKPEQVGASPRKPCIILSW

SEQ ID NO: 752966 - protein, 121 aa, Homo sapiens
MNTEAEQQLLHHARNGNAEEVRQLLETMARNEVIADINCKGRSKSNLGWTPLHLACYFGHRQVVQDLLKAGAEVNVLNDMGDTPLHRAAFTGRKMECRSVGQDGVQWHDLGSLQPPPPEFK

SEQ ID NO: 752967 - protein, 125 aa, Homo sapiens
EAESCWVAQAGVQWCNLGSLQPSPPKFKPFFSLSLQCSWDYRHPPPCPANFCLFSRDGVSSQGQAGLEFLTSSNPPRSASQSAGITGVSHCAWPESTFRKHYSFTFFKLEALRKSQPFAHLRQRH

SEQ ID NO: 752968 - protein, 101 aa, Homo sapiens
ISRSKTTLFSERPFPHLCPHRSPPSPLRPLPGLLSPLHLFQEASQSPRAVPSAPGVRLQMPRKAQRDCFLSPTGLCPKAGEFWSQAGVRKVPGLWPLIAPL

SEQ ID NO: 752969 - protein, 360 aa, Homo sapiens
MWSECEGPEMSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKGEHGVKEVLNILTNEFHTSMALTGCRSVAEINRNLVQFSRL

SEQ ID NO: 752970 - protein, 144 aa, Homo sapiens
KSESQNRKPSSPCVSPFQIDALTEVVAAVKGKIEVYLDGGVRTGNDVLKALALGAKCIFLGRPILWGLACKVRVAKQTSKKIQSFSFISVLSCGSFSKLRHFQAHCKCSIAFIPYLCLCAFLYSQGNSHFTDNPHLSHYSSDYI

SEQ ID NO: 752971 - protein, 107 aa, Homo sapiens
MSSTLPWPLQAAGRSLRSIETWSSFPGCKKKGPITRLLRLPTGGSQTHSTVCDAVLPGPHSVRRLMAHISHISNTTTPVLQALQTPVFPKCSMPFFVSLTIICCSLA

SEQ ID NO: 752972 - protein, 351 aa, Homo sapiens
MSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKGEHGVKEVLNILTNEFHTSMALTGCRSVAEINRNLVQFSRL

SEQ ID NO: 752973 - protein, 392 aa, Homo sapiens
MWSECEGPEMSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKVRVAKQTSKKIQSFSFISVLSCGSFSKLRHFQAHCKCSIAFIPYLCLCAFLYSQGNSHFTDNPHLSHYSSDYI

SEQ ID NO: 752974 - protein, 579 aa, Homo sapiens
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTVSVENGDRGSKTFNLGTDPVSLRNYPYKICDSCEMNLKNISGLIISKKNCSRKKPDEFNVCEKLLLDIRHEKIPIGEKSYKYDQKRNAINYHQDLSQPSFGQSFEYSKNGQGFHDEAAFFTNKRSQIGETVCKYNECGRTFIESLKLNISQRPHLEMEPYGCSICGKSFCMNLRFGHQRALTKDNPYEYNEYGEIFCDNSAFIIHQGAYTRKILREYKVSDKTWEKSALLKHQIVHMGGKSYDYNENGSNFSQKSHLTQLRRAHTGEKTFECGECGKTFWEKSNLTQHQRTHTGEKPYECTECGKAFCQKPHLTNHQRTHTGEKPYECKQCGKTFCVKSNLTEHQRTHTGEKPYECNACGKSFCHRSALTVHQRTHTGEKPFICNECGKSFCVKSNLIVHQRTHTGEKPYKCNECGKTFCEKSALTKHQRTHTGEKPYECNACGKTFSQRSVLTKHQRIHTRVKALSTS

SEQ ID NO: 752975 - protein, 579 aa, Homo sapiens; identical to SEQ ID NO: 752974

SEQ ID NO: 752976 - protein, 119 aa, Homo sapiens
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTWNLKLIKVE

SEQ ID NO: 752977 - protein, 579 aa, Homo sapiens; identical to SEQ ID NO: 752974

SEQ ID NO: 752978 - protein, 579 aa, Homo sapiens; identical to SEQ ID NO: 752974

SEQ ID NO: 752979 - protein, 579 aa, Homo sapiens; identical to SEQ ID NO: 752974

SEQ ID NO: 752980 - protein, 148 aa, Homo sapiens
MNKSQEQVSFKDVCVDFTQEEWYLLDPAQKILYRDVILENYSNLVSVGYCITKPEVIFKIEQGEEPWILEKGFPSQCHPGSGTGNTAAQNAVEEAFEFLFRLVHIVTLCAIFHTTESRSIAQTGVQWRDLGSLQPVAPTFKQFSASAS

SEQ ID NO: 752981 - protein, 68 aa, Homo sapiens
GLPGPDLGSEGRSSRQDPLTERCLPHLGTSRRTSRVQALPLWLSLCSVGPGDSGNPPGLQRLRCRMGK

SEQ ID NO: 752982 - protein, 71 aa, Homo sapiens
LPGSSNSHASASQVAGTTGAHHCARLTFCVLVEMGFHHVAQGGLERLSSGNPPTSASQSAGITGKNHRVRP

SEQ ID NO: 752983 - protein, 74 aa, Homo sapiens
LVNFPPKKEGSLMIGYPNSTHHLPLNSMPDRSRFLGLLTRDEHQDFMDEQKRLKKLRGKEKPKKGEGKRAAKRK

SEQ ID NO: 752984 - protein, 74 aa, Homo sapiens; identical to SEQ ID NO: 752983

SEQ ID NO: 752985 - protein, 87 aa, Homo sapiens
ELVLGKSLPKCFKVECVKVLFPRVGLGQGRILAAQEEEKPLSPLPGLDKLETLYSCWVTSGGCLKHKQCTSRPATERNGAFEAQKKK

SEQ ID NO: 752986 - protein, 124 aa, Homo sapiens
HFLVRFLGGLLGVHPAAYWLKMYSPFMWSLWGRLGEREINSATVLILNIDKCLFEIKNQSLQKKKKGSAARDLKLVGRVGRPTRPKRIGSWGILIPMVSGCSELAPTMSLDLFWCYLINSQQAY

SEQ ID NO: 752987 - protein, 148 aa, Homo sapiens
LCYGPPIENGFYYDMFIEDRAVSSTELSALENICKAIIKEKQPFERLEVSKEILLEMFKYNKFKCRILNEKVNTATTTVYRCGPLIDLCKGPHVRHTGKIKTIKIFKNSSTYWEGNPEMETLQRIYGISFPDNKMMRDWDKNFSFSTI

SEQ ID NO: 752988 - protein, 551 aa, Homo sapiens
LCYGPPIENGFYYDMFIEDRAVSSTELSALENICKAIIKEKQPFERLEVSKEILLEMFKYNKFKCRILNEKVNTATTTVYRCGPLIDLCKGPHVRHTGKIKTIKIFKNSSTYWEGNPEMETLQRIYGISFPDNKMMRDWEKFQEEAKNRDHRKIGKEQELFFFHDLSPGSCFFLPRGAFIYNTLTDFIREEYHKRDFTEVLSPNMYNSKLWEASGHWQHYSENMFTFEIEKDTFALKPMNCPGHCLMFAHRPRSWREMPIRFADFGVLHRNELSGTLSGLTRVRRFQQDDAHIFCTVEQIEEEIKGCLQFLQSVYSTFGFSFQLNLSTRPENFLGEIEMWNEAEKQLQNSLMDFGEPWKMNPGDGAFYGPKIDIKIKDAIGRYHQCATIQLDFQLPIRFNLTYVSKDGDDKKRPVIIHRAILGSVERMIAILSENYGGKWPFWLSPRQVMVIPVGPTCEKYALQVSSEFFEEGFMADVDLDHSCTLNKKIRNAQLAQYNFILVVGEKEKIDNAVNVRTRDNKIHGEILVTSAIDKLKNLRKTRTLNAEEAF

SEQ ID NO: 752989 - protein, 165 aa, Homo sapiens
LCYGPPIENGFYYDMFIEDRAVSSTELSALENICKAIIKEKQPFERLEVSKEILLEMFKYNKFKCRILNEKVNTATTTVYRCGPLIDLCKGPHVRHTGKIKTIKIFKNSSTYWEGNPEMETLQRIYGISFPDNKMMRDWEKFQEEAKNRDHRKIGKDKNFSFSTI

SEQ ID NO: 752990 - protein, 551 aa, Homo sapiens; identical to SEQ ID NO: 752988

SEQ ID NO: 752991 - protein, 109 aa, Homo sapiens
TTNIDDLTVPTSQGLGAAQLVDSGAERLLGLQSGCRPGLRSSGLAHSWWMQLLITWVLACLNVLTAWWLVSPRASDLREMGAAAFYKLVSETMRRHFRTSLWSRRPALV

SEQ ID NO: 752992 - protein, 240 aa, Homo sapiens
VTDANMAAPSGVHLLVRRGSHRIFSSPLNHIYLHKQSSSQQRRNFFFRRQRDISHSIVLPAAVSSAHPVPKHIKKPDYVTTGIVPDWGDSIEVKNEDQIQGLHQACQLARHVLLLAGKSLKVDMTTEEIDALVHREIISHNAYPSPLGYGGFPKSVCTSVNNVLCHGIPDSRPLQDGDIINIDVTVYYNGYHGDTSETFLVGNVDECGKKLVEVARRCRDEAIAACRAGAPFSVIGNTIR

SEQ ID NO: 752993 - protein, 132 aa, Homo sapiens
VTDANMAAPSGVHLLVRRGSHRIFSSPLNHIYLHKQSSSQQRRNFFFRRQRDISHSIVLPAAVSSAHPVPKHIKKPDYVTTGIVPDWGDSIEVKNEDQIQGLHQACQLARHVLLLAGKSLKVASHQASERLT

SEQ ID NO: 752994 - protein, 132 aa, Homo sapiens; identical to SEQ ID NO: 752993

SEQ ID NO: 752995 - protein, 738 aa, Homo sapiens
MEPKPATKKATRTKAISEDLSQEAILEKLTENGLWDSRMEGLWKWNDRILRLQNNQENHLSQRIIPLKKTPTSQRGFRFESILIPEPGIATEELHSRCQTQEENFTENLNLITDTHLGKIICKEMKGSKAIRQTSELTLGKKSNNKEKPYKCSTCEKAFHYRSLLIQHQRTHTKEKPYECNECGKTFSQPSYLSQHKKIHTGEKPYKCNECGKAFIASSSLMVHQRIHTKEKPYQCNVCGKSFSQCARLNQHRIQTGEKPYKCSECGKAFSDKSKLARHQETHNGEKPYKCDDCGKAFRNKSYLSVHQKTHTEEKPYQCNECGKSFKNTTIFNVHQRIHTGEKPFRCNECGKAYRSNSSLIVHIRTHTGEKPYECNECGKAFNRIANFTEHQRIHTGEKPYKCNECGKAFINYSCLTVHHRMHTGEKPYKCTECGKAFMRSSSLIIHQRIHTEEKPYLCNECGESFRIKSHLTVHQRIHTGEKPYKCTDCERAFTKMVNLKEHQKIHTGVKPYKCYDCGKSFRTKSYLIVHQRTHTGEKPYKCNECEKAFTNTSQLTVHQRRHTGEKPYKCNECGKVFTSNSGFNTHQRTHTGEKPFKCNDCGKAFSQMVHVTEHQKIHSGEKPYKCDVCGKAFRRGSYLTVHWRTHTGEKPYTCKECGKGCITLSQLTLHQRIHTGERPYKCEECGKAFRTNSDFTVHLRMHTGEKPYKCNECGKAFRSSSSLTVHQRIHQRETQLI

SEQ ID NO: 752996 - protein, 232 aa, Homo sapiens
MAGDVGGRSCTDSELLLHPELLSQEFLLLTLEQKNIAVETDVRVNKDSLTDLYVQHAIPLPQRDLPKNRWGKMMEKKREQHEIKNETKRSSTVDGLRKRPLIVFDGSSTSTSIKVKKTENGDNDRLKPPPQASFTSNAFRKLSNSSSSVSPLILSSNLPVNNKTEHNNNDAKQNHDLTHRKSPSGPVKSPPLSPVGTTPVKLKRAAPKEEAEAMNNLKPPQAKRKIQHVTWP

SEQ ID NO: 752997 - protein, 232 aa, Homo sapiens; identical to SEQ ID NO: 752996

SEQ ID NO: 752998 - protein, 190 aa, Homo sapiens
MAGDVGGRSCTDSELLLHPELLSQEFLLLTLEQKNIAVETDVRVNKDSLTDLYVQHAIPLPQRDLPKNRWGKMMEKKREQHEIKNETKRSSTVDGLRKRPLIVFDGSSTSTSIKVKKTENGDNDRLKPPPQNHDLTHRKSPSGPVKSPPLSPVGTTPVKLKRAAPKEEAEAMNNLKPPQAKRKIQHVTWP

SEQ ID NO: 752999 - protein, 232 aa, Homo sapiens; identical to SEQ ID NO: 752996

SEQ ID NO: 753000 - protein, 68 aa, Homo sapiens
CSYFHCGPRGLFQGSVLAQGKVDHETSQPERSSSQLSFRMDLKSSQQRRYQFENQDVFDLLWPSRDTS

SEQ ID NO: 753001 - protein, 91 aa, Homo sapiens
GRTPATHGGFLAPELRTGSTRAEPTVLGLGALGVTKTSTWPADLRPSLAPPCWAQLRCQETHGHWPLNGWHPQASQVPRGAEPFGGQRVAS

SEQ ID NO: 753002 - protein, 370 aa, Homo sapiens
MANYSHAADNILQNLSPLTAFLKLTSLGFIIGVSVVGNLLISILLVKDKTLHRAPYYFLLDLCCSDILRSAICFPFVFNSVKNGSTWTYGTLTCKVIAFLGVLSCFHTAFMLFCISVTRYLAIAHHRFYTKRLTFWTCLAVICMVWTLSVAMAFPPVLDVGTYSFIREEDQCTFQHRSFRANDSLGFMLLLALILLATQLVYLKLIFFVHDRRKMKPVQFVAAVSQNWTFHGPGASGQAAANWLAGFGRGPTPPTLLGIRQNANTTGRRRLLVLDEFKMEKRISRMFYIMTFLFLTLWGPYLVACYWRVFARGPVVPGGFLTAAVWMSFAQAGINPFVCIFSNRELRRCFSTTLLYCRKSRLPREPYCVI

SEQ ID NO: 753003 - protein, 370 aa, Homo sapiens; identical to SEQ ID NO: 753002

SEQ ID NO: 753004 - protein, 370 aa, Homo sapiens; identical to SEQ ID NO: 753002

SEQ ID NO: 753005 - protein, 413 aa, Homo sapiens
MYTSHEDIGYDFEDGPKDKKTLKPHPNIDGGWAWMMVLSSFFVHILIMGSQMALGVLNVEWLEEFHQSRGLTAWVSSLSMGITLIVGPFIGLFINTCGCRQTAIIGGLVNSLGWVLSAYAANVHYLFITFGVAAGLGSGMAYLPAVVMVGRYFQKRRALAQGLSTTGTGFGTFLMTVLLKYLCAEYGWRNAMLIQGAVSLNLCVCGALMRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGWRSSVR

SEQ ID NO: 753006 - protein, 151 aa, Homo sapiens
SRFVGRDEEKPNVKTPGVSRAQLWLLPGSPKPWRVLAANRSLVRRQASPTKSGEFQDCGVGLNAAQFKQLLISAVKDLFGEVDAALPLDILTYEEKTLSAILRICSSGLVKLWSSLTLLGSYKGKKCAFRVIQVSPFLLALSGNSRELVLD

SEQ ID NO: 753007 - protein, 124 aa, Homo sapiens
MPAPAATYERVVYKNPSEYHYMKVCLEFQDCGVGLNAAQFKQLLISAVKDLFGEVDAALPLDILTYEEKTLSAILRICSSGLVKLWSSLTLLGSYKGKKCAFRVIQVSPFLLALSGNSRELVLD

SEQ ID NO: 753008 - protein, 124 aa, Homo sapiens; identical to SEQ ID NO: 753007

SEQ ID NO: 753009 - protein, 168 aa, Homo sapiens [sequence omitted]

SEQ ID NO: 753010 - protein, 77 aa, Homo sapiens
ESKQCTESKQCSESKQCPESKQCPESKQCLKLWFQKLPNPEIDVLKMQPQTPMLLLKSLWGIAALYQRMVDRPRSPS

SEQ ID NO: 753011 - protein, 124 aa, Homo sapiens; identical to SEQ ID NO: 753007

SEQ ID NO: 753012 - protein, 124 aa, Homo sapiens; identical to SEQ ID NO: 753007

SEQ ID NO: 753013 - protein, 124 aa, Homo sapiens; identical to SEQ ID NO: 753007

SEQ ID NO: 753014 - protein, 151 aa, Homo sapiens; identical to SEQ ID NO: 753006

SEQ ID NO: 753015 - protein, 124 aa, Homo sapiens; identical to SEQ ID NO: 753007

SEQ ID NO: 753016 - protein, 168 aa, Homo sapiens [sequence omitted]

SEQ ID NO: 753017 - protein, 124 aa, Homo sapiens; identical to SEQ ID NO: 753007

SEQ ID NO: 753018 - protein, 124 aa, Homo sapiens; identical to SEQ ID NO: 753007

SEQ ID NO: 753019 - protein, 76 aa, Homo sapiens
SSKGLHTAPALCRAERADSFPGALKSPGPPQWLCEPHCVASEIVLPKKRVCLQVKSQGREWLRFPGGPSVGRLLGP

SEQ ID NO: 753020 - protein, 90 aa, Homo sapiens
AELEAESLWPRGPGRNRGSFALFFLEWGSRIANENRETRLSADSSSRPYIWSKRKGPPLLHKRLENGRLFINLWIRLLSAAAPRPPRRLG

SEQ ID NO: 753021 - protein, 268 aa, Homo sapiens
APSAAAAAGPGARGLGGGGWGRTPSAEAGARAEGAAGLRARWGAWRGAEGEMSLVGGFPHHPVVHHEGYPFAAAAAAAAAAAASRCSHEENPYFHGWLIGHPEMSPPDYSMALSYSPEYASGAAGLDHSHYGGVPPGAGPPGLGGPRPVKRRGTANRKERRRTQSINSAFAELRECIPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 753022 - protein, 90 aa, Homo sapiens; identical to SEQ ID NO: 753020

SEQ ID NO: 753023 - protein, 90 aa, Homo sapiens; identical to SEQ ID NO: 753020

SEQ ID NO: 753024 - protein, 268 aa, Homo sapiens; identical to SEQ ID NO: 753021

SEQ ID NO: 753025 - protein, 141 aa, Homo sapiens
MARARRLELAEALALGPGQRHACYALLHAPDPGILSGRLPLRYAILMQMRFDGRLGFPGGFVDSQDSSLEDGLNRGLLELLGEAAAAFRVERPDYRSSHAGSRPRVVAHFYAKSLTLEQLLAVEASATGAKDHGLEVLGLV

SEQ ID NO: 753026 - protein, 188 aa, Homo sapiens
VGLRNSGRAVSGHGQGPQAGAGRGPGAGARLEACLLCAPARAGPWNSLWPPPSALRHTGEEGARPATLRSGLAPSLRRYSRVSLPIPASSSLQMQMRFDGRLGFPGGFVDSQDSSLEDGLNRGLLELLGEAAAAFRVERPDYRSSHAGSRPRVVAHFYAKSLTLEQLLAVEASATGAKDHGLEVLGLV

SEQ ID NO: 753027 - protein, 188 aa, Homo sapiens; identical to SEQ ID NO: 753026

SEQ ID NO: 753028 - protein, 188 aa, Homo sapiens; identical to SEQ ID NO: 753026

SEQ ID NO: 753029 - protein, 99 aa, Homo sapiens
ARIQLRGTFTRTMPSPDHLPRTCSRLLMAERQKTMTMYARTKSTNRVLDHHCNNSKRRPKAVGKSREEVTSILKNTACNSRTAHVDEVVAVENVETKFV

SEQ ID NO: 753030 - protein, 140 aa, Homo sapiens
MRFDGRLGFPGGFVDSQDSSLEDGLNRGLLELLGEAAAAFRVERPDYRSSHAGSRPRVVAHFYAKSLTLEQLLAVEASATGAKDHGLEVGPVWDPAPYLIPFPSMSSFASATLFGLRSPSVRTCPLPHFLGGVGILVFSY

SEQ ID NO: 753031 - protein, 114 aa, Homo sapiens
RRRAELSQHGPLADWPPRGFGQWAPVGRLSSCGGAGSSKALAASPAIRRLRRRRGQPDLSLRSGSLPPAPAELPAGTGCGPTAQGRLQGWGRALFFAGSSSEPALARRPSNLRR

SEQ ID NO: 753032 - protein, 197 aa, Homo sapiens
MAAGCCGVKKQKLSSSPPSGSGGGGGASSSSHCSGESQCRAGELGLGGAGTRLNGLGGLTGGGSGSGCTLSPPQGCGGGGGGIALSPPPSCGVGTLLSTPAAATSSSPSSSSAASSSSPGSRKMVVSAEMCCFCFDVLYCHLYGYQQPRTPRFTNEPYPLFVTWKIGRDKRLRGCIGTFSAMNLHSGLREYTLTSLE

SEQ ID NO: 753033 - protein, 333 aa, Homo sapiens
MAAGCCGVKKQKLSSSPPSGSGGGGGASSSSHCSGESQCRAGELGLGGAGTRLNGLGGLTGGGSGSGCTLSPPQGCGGGGGGIALSPPPSCGVGTLLSTPAAATSSSPSSSSAASSSSPGSRKMVVSAEMCCFCFDVLYCHLYGYQQPRTPRFTNEPYPLFVTWKIGRDKRLRGCIGTFSAMNLHSGLREYTLTSALKDSRFPPMTRDELPRLFCSVSLLTNFEDVCDYLDWEVGVHGIRIEFINEKGSKRTATYLPEVAKEQGWDHIQTIDSLLRKGGYKAPITNEFRKTIKLTRYRSEKMTLSYAEYLAHRQHHHFQNGIGHPLPPYNHYS

SEQ ID NO: 753034 - protein, 333 aa, Homo sapiens; identical to SEQ ID NO: 753033

SEQ ID NO: 753035 - protein, 333 aa, Homo sapiens; identical to SEQ ID NO: 753033

SEQ ID NO: 753036 - protein, 333 aa, Homo sapiens; identical to SEQ ID NO: 753033

SEQ ID NO: 753037 - protein, 333 aa, Homo sapiens; identical to SEQ ID NO: 753033

SEQ ID NO: 753038 - protein, 252 aa, Homo sapiens
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKDTAFIPIPLVDTSIQGFPQDGLMACI

SEQ ID NO: 753039 - protein, 327 aa, Homo sapiens
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKLKKDKALMGHFQDGLSYSVFKTITDQVLMGVDPRGESEVKAQGFKAALVIDVTAKLTAIDNHPMNRVLGFGTKYLKENFSPWIQQHGGWEKILGISHEEVD

SEQ ID NO: 753040 - protein, 339 aa, Homo sapiens
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKLKKDKALMGHFQDGLSYSVFKTITDQVLMGVDPRGESEVKAQGFKAALVIDVTAKLTAIDNHPMNRVLGFGTKYLKENFSPWIQQHGGWVSVSYLKTNFLRTQKRWDGFFFFF

SEQ ID NO: 753041 - protein, 276 aa, Homo sapiens
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKEKEWEESAKTKIKMALLWRSSGGGPRVLSIPEAFMKNSFTLTPPGFSEHN

SEQ ID NO: 753042 - protein, 339 aa, Homo sapiens; identical to SEQ ID NO: 753040

SEQ ID NO: 753043 - protein, 339 aa, Homo sapiens; identical to SEQ ID NO: 753040

SEQ ID NO: 753044 - protein, 527 aa, Homo sapiens
DILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGKKYHVKSKSAKPSTNVKKSIRKKYCKVSSSSSSSLSSSSSGSGTDCLDAGSDSHLSDSSPSSKSSKKHVSGITLLSPKHKYKSGIKSTETQPSSTTPKCGHYPEESEDTVTDVSPLSTPDISPLQSFELGIANDQKVKIKKQENVSQEIYEDVEDLKNNSKYLKAAKKGKEKHEPDVSSKSSSVLDSSLDHRHKQKVLHDTMDLNHLLKAFLQLDKKGPQKHHFDQPSVAPGKNYSFTREEVRQIDRENQRLLKELSRQAEKPGSKSTIPRSADHPPKLYHSALNRQKEQQRIERENLALLKRLEAVKPTVGMKRSEQLMDYHRNMGYLNSSPLSRRARSTLGQYSPLRASRTSSATSGLSCRSERSAVDPSSGHPRRRPKPPNVRTAWL

SEQ ID NO: 753045 - protein, 106 aa, Homo sapiens
MISPSLELLHSGLCKFPEVEGKMTTFKEAVTFKDVAVVFTEEELGLLDPAQRKLYRDVMLENFRNLLSVGNQPFHQDTFHFLGKEKFWKMKTTSQREGNSGRKFPS

SEQ ID NO: 753046 - protein, 617 aa, Homo sapiens
MISPSLELLHSGLCKFPEVEGKMTTFKEAVTFKDVAVVFTEEELGLLDPAQRKLYRDVMLENFRNLLSVGNQPFHQDTFHFLGKEKFWKMKTTSQREGNSGGKIQIEMETVPEAGPHEEWSCQQIWEQIASDLTRSQNSIRNSSQFFKEGDVPCQIEARLSISHVQQKPYRCNECKQSISDVSVFDLHQQSHSGEKSHTCGECGKSFCYSPALHIHQRVHMGEKCYKCDVCGKEFNQSSHLQTHQRVHTGEKPFKRGQCGKGFHSRSALNVHCKLHTGEKPYNCEECGKAFIHDSQLQEHQRIHTGEKPFKCDICGKSFRVRSRLNRHSMVHTGEKPFRCDTCGKNFRQRSALNSHSMVHIEEKPYKCEQCGKGFICRRDFCKHQMVHTGEKPYNCKECGKTFRWSSCLLNHQQVHSGQKSFKCEECGKGFYTNSRRSSHQRSHNGEKPYNCEECGKDYKRRLDLEFHQRVHTGERPYNCKECGKSFGWASCLLKHQRLHSGEKPFKCEECGKRFTQSTQLHSHQTCHTGEKLYKCEQCEKGYNSKFNLDMHQRVHRGERPYNCKECGKSFGWASCLLKHQRLHSGEKPLKSGVWEEIYSEFTASFTSVSLCGRKAI

SEQ ID NO: 753047 - protein, 107 aa, Homo sapiens
LNFFRLKALHNWKVAHTTHYGLRAPLVWSLTPGQPSSPTHHSAFSPFATATWAFLVLSRCPHLVLLQDFALDGKPGLVLSFKTFVSFHSNAKFSEGLPCHTPSQKSS

SEQ ID NO: 753048 - protein, 373 aa, Homo sapiens
HKSEKDQAGLEPLALRLSRELQEKEKVIEVLQAKLDARSLTPSSSRALSDSHRSPSSTSFLSDELEACSDMDIVSEYTHYEEKKASPSHSDSIHHSSHSAVLSSKPSSTSASQGAKAESNSNPISLPTPQNTPKEANQAHSGTSTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDCLREQLEHRLTSTARGRGSTSNFYSQGLESIPQLCNENRVLREENRRLQAQLSHVSREHSQETESLREALLSSRSHLQELEKELEHQKVERQQLLEDLREKQQEVLHFREERLSLQENDSR

SEQ ID NO: 753049 - protein, 328 aa, Homo sapiens
HKSEKDQAGLEPLALRLSRELQEKEKVIEVLQAKLDARSLTPSSSRALSDSHRSPSSTSFLSDELEACSDMDIVSEYTHYEEKKASPSHSDSIHHSSHSAVLSSKPSSTSASQGAKAESNSNPISLPTPQNTPKEANQAHSGTSTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDCLREQLEHRLTSTARGRGSTSNFYSQGLESIPQLCNENRVLREENRRLQAQLSHVSRARRFERKGHCWGTITKVNR

SEQ ID NO: 753050 - protein, 554 aa, Homo sapiens
HKSEKDQAGLEPLALRLSRELQEKEKVIEVLQAKLDARSLTPSSSRALSDSHRSPSSTSFLSDELEACSDMDIVSEYTHYEEKKASPSHSDSIHHSSHSAVLSSKPSSTSASQGAKAESNSNPISLPTPQNTPKEANQAHSGTSTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDCLREQLEHRLTSTARGRGSTSNFYSQGLESIPQLCNENRVLREENRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKDSAVSPPVRDVGMNSPALVFPSSASSTPGSETPIINRANGWVGYSPSNEDPPKPEGEATKVLTIAWLPCPPLSTHGLKQMRGKRAKDGPGTRSDAWASKAPRLHDAGDAKRTTGEGNHGDRTEEHNHRTPRPKPADATRP

SEQ ID NO: 753051 - protein, 1503 aa, Homo sapiens
SEGAGAAAGGGEGLRSSAAAGPAGAGGSDEYSEGEGKGGGRALAAAPCSPSRMTRGGGSGSSRGSRDRVAARWGWAPLAPPREAPARSGTRPPRGSRARLRRVAAAAAAAAMSPGKPGAGGAGTRRTGWRRRRRRRRQEAATTVPGLGRTAGPDSRVRGTFQGARGMKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYDDFKKGASDTYVTYLIRTEEKGRSQSLSEVLKYEIDVGNESTTLGYYNGKLEPLGSYRACVAGFTNITFHPQNKGLIDGAESYVSFSRYSDAVSLPQDPGVICGAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 753052 - protein, 730 aa, Homo sapiens
SEGAGAAAGGGEGLRSSAAAGPAGAGGSDEYSEGEGKGGGRALAAAPCSPSRMTRGGGSGSSRGSRDRVAARWGWAPLAPPREAPARSGTRPPRGSRARLRRVAAAAAAAAMSPGKPGAGGAGTRRTGWRRRRRRRRQEAATTVPGLGRTAGPDSRVRGTFQGARGMKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTGKQIGFSVKPSCFLKEISIINKHNVS

SEQ ID NO: 753053 - protein, 108 aa, Homo sapiens
PSPIPDPSVATVATGENGITQISSTAESFHKQNGTGTPQVETNTSEDGESSGANDSLRTPEQGSNGTDGASQKTPSSTGKHRLFCQSCFLKEIGRIYKCHVFQILFFF

SEQ ID NO: 753054 - protein, 705 aa, Homo sapiens
SEGAGAAAGGGEGLRSSAAAGPAGAGGSDEYSEGEGKGGGRALAAAPCSPSRMTRGGGSGSSRGSRDRVAARWGWAPLAPPREAPARSGTRPPRGSRARLRRVAAAAAAAAMSPGKPGAGGAGTRRTGWRRRRRRRRQEAATTVPGLGRTAGPDSRVRGTFQGARGMKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTG

SEQ ID NO: 753055 - protein, 383 aa, Homo sapiens
MENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTG

SEQ ID NO: 753056 - protein, 159 aa, Homo sapiens
LMLCCTCFADPASMASFDCEVVPKEPALVLKWTCPPGANAGFELEVSSGAWNNATHLESCSSENGTEYRTEVTYLNFSTSYNISITTVSCGKMAAPTRNTCTTGITGGLQGRGWSVGTVITPGAADPQWVCTCGLEICFCFFISPKIFAFTDIDWFLIL

SEQ ID NO: 753057 - protein, 248 aa, Homo sapiens
LTRGRSVEQSPPRERPRAAGRRGRMAEASGRRGSPRARKASRSQSETSLLGRASAVPSGPPKYPTAEREEPRPPRPRRGPAPTLAAQAAGSCRRWRSTAEIDAADGRRVRPRAPAARVPGPGPSPSAPQRRLLYGCAGSDSECSAGRLGPLGRRGPAGGVGGGYGESESSASEGESPAFSSASSDSDGSGGLVWPQQLVAATAASGGGAGAGAPAGPAKVFVKIKASHALKKKILRFRSGSLKVMTTV

SEQ ID NO: 753058 - protein, 248 aa, Homo sapiens; identical to SEQ ID NO: 753057

SEQ ID NO: 753059 - protein, 248 aa, Homo sapiens; identical to SEQ ID NO: 753057

SEQ ID NO: 753060 - protein, 248 aa, Homo sapiens; identical to SEQ ID NO: 753057

SEQ ID NO: 753061 - protein, 98 aa, Homo sapiens
MVYAPEWISSTRPSRTRGQLYLLGIFINLGRQECLDAITLTQLHMLSDLSIYHNKSAHIIEAYHPQKPFCKQDWTQLEKDERTCLGRLLCRTDRGAAQ

SEQ ID NO: 753062 - protein, 160 aa, Homo sapiens
GRPGPGPRRAPGSVREPGDLRPSCPPSREERGAAAAAAAEMMEELHSLDPRRQELLEARFTGVGVSKGPLNSESSNQSLCSVGSLSDKEVETPEKKQNDQRNRKRKAEPYETSQGKGTPRGHKISDYFERRVEQPLYGLDGSAAKEGNGGAVCSGQPSCQ

SEQ ID NO: 753063 - protein, 104 aa, Homo sapiens
VISHIAAGAERSLCCDVLHLSSCAPKAPPLLTLLYCSTRSKTHESCCLPIAPFHNTVTCAELELIIQTKKDKKHKATGLLPDSTMTFLKPKSNILSSALSESEF

SEQ ID NO: 753064 - protein, 69 aa, Homo sapiens
ILKASVEGKGWEVGAVPSPLPTASGRCATSGGFLTVGVGGTPFSQSAKWGHTMAAPGVARWGPDVGGVQ

SEQ ID NO: 753065 - protein, 259 aa, Homo sapiens
LLETAREFEIDFAGTDSGCYSAFVVWARSAMGMFVDAFSKQVFDSKESLSTAAECVKVAKEHCQQLGDIGLDLTFIIHALLVKDIQGALHSYKEIIIEATKHRNSEEMWRRMNLMTPEALGKLKEEMKSCGVSNFEQYTGDDCWVNLSYTVVAFTKQTMGFLEEALKLYFPELHMVLLESLVEIILVAVQHVDYSLRCEQDPEKKAFIRQNASFLYETVLPVVEKRFEEGVGKPAKQLQDLRNASRLIRVNPESTTSVV

SEQ ID NO: 753066 - protein, 259 aa, Homo sapiens; identical to SEQ ID NO: 753065

SEQ ID NO: 753067 - protein, 71 aa, Homo sapiens
LPSALSTFQAGLAIGQEQALQQCHGDPRGRVGAWTGLPLLRLRQAGLDAGGGASISPARLPFGQGGYLWNG

SEQ ID NO: 753068 - protein, 71 aa, Homo sapiens; identical to SEQ ID NO: 753067

SEQ ID NO: 753069 - protein, 175 aa, Homo sapiens [sequence omitted]

SEQ ID NO: 753070 - protein, 641 aa, Homo sapiens
MSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 753071 - protein, 448 aa, Homo sapiens
MSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 753072 - protein, 139 aa, Homo sapiens
RSSSYPVQYTAVGKILEPEERTAALINLTANMLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTGKSSGHAHT

SEQ ID NO: 753073 - protein, 617 aa, Homo sapiens
RSSSYPVQYTAVGKILEPEERTAALINLTANMLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 753074 - protein, 471 aa, Homo sapiens
MSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 753075 - protein, 506 aa, Homo sapiens
RSSSYPVQYTAVGKILEPEERTAALINLTANMLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTLHAIHLPLHTPTSVSHRLQHCQFLSEVGLFIMSGLFHDPGADHHLSD

SEQ ID NO: 753076 - protein, 586 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 753077 - protein, 356 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQ

SEQ ID NO: 753078 - protein, 143 aa, Homo sapiens
RSSSYPVQYTAVGKILEPEERTAALINLTANMLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTTYSIEPDSFRDPV

SEQ ID NO: 753079 - protein, 501 aa, Homo sapiens
MLYLENNAQTQFSEYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 753080 - protein, 424 aa, Homo sapiens
RSSSYPVQYTAVGKILEPEERTAALINLTANMLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 753081 - protein, 277 aa, Homo sapiens
GTGRQASYTPASGTMAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 753082 - protein, 277 aa, Homo sapiens; identical to SEQ ID NO: 753081

SEQ ID NO: 753083 - protein, 277 aa, Homo sapiens; identical to SEQ ID NO: 753081

SEQ ID NO: 753084 - protein, 128 aa, Homo sapiens
RLVRPGCDRNWAPTGLDWAGLGMGGLWEDPSLVPSPTTQAPASQRVARNTRADEKGCRDRRGIWLVGTGWTLAPILSTCPQATGSCHPPLLSCSGPCRRAWAAWGLWGDELTLAPQTCGSKESSHGHS

SEQ ID NO: 753085 - protein, 114 aa, Homo sapiens
LGQRQQHSAVNSPSGTQVDEGPAISNAGSQNPLGIGLPLVEQEKEHAWEVFMGQAWKWCHYIPPTRTQSHGHTCVSARQAGKCHLSLCPEKKRAWIWQTESQNQSLPQEITYLH

SEQ ID NO: 753086 - protein, 121 aa, Homo sapiens
YLCKYLCLQMRFHPEQLGVRTSIYEFDREGRRREQNSTHSSNNLIASCEQAKRMFIVSLIGAIPYSYVTCALSYSLSVLNCKHSSTNKLRLITRDKKEMPCNLVSCECFKWIPEKLYLRMA

SEQ ID NO: 753087 - protein, 655 aa, Homo sapiens
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 753088 - protein, 386 aa, Homo sapiens
LWKFETSKYYVTITDAPGHRDFIKNMITGTSQADCAVPIVAAGVGEFEAGISKNGQTREHALLAYTLGVKQLIVGVNKMDSTEPPYSQKRYEEIVKEVSTYIKKIGYNPDTVAFVPISGWNGNNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 753089 - protein, 82 aa, Homo sapiens
FDKSILNVSPISTATSHSGEKPGNEPEEVKLQNASKQIVQNAILQAVQQVSQESQRREERISDNRDHIQLGVGELTKKHEKK

SEQ ID NO: 753090 - protein, 213 aa, Homo sapiens
LLAFALARGSVAKVMSSLCTITDHLDTQYDASSLILSMASVRQNLLLKYGKPLQLTLQACDVKGKEDKSGPENLLVEPWTRDGFLTETGKTRASTIFSTGTESAFQVTQIRIMVRRGGIGAQCGLVFAYNSSSDKFCAEEHFKRFEKYDKWKLQELRQFVKSRIGCSSDDLGEDDPIGWFELEEEWDEADVKLQQCRVAKVSISEFVCPLQPP

SEQ ID NO: 753091 - protein, 314 aa, Homo sapiens [sequence omitted]

SEQ ID NO: 753092 - protein, 212 aa, Homo sapiens
TPDPYLCCSCCKGKDQKKIHGGRVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 753093 - protein, 242 aa, Homo sapiens
FSLPISTPVAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 753094 - protein, 220 aa, Homo sapiens
TPDALPLLQLLVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 753095 - protein, 167 aa, Homo sapiens
LFIPLQDFDAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 753096 - protein, 126 aa, Homo sapiens
MELREEAWSPGPLDSEDQQMASHENPGEQPEAFPADPAASHLTLASFASGWEETPLPCFPLLGPWDHPTLASPPALGLALLAVEGGLVLWLQVSFLLDDLGDPWGPPSLPDFLCPCPSSLGSTPVC

SEQ ID NO: 753097 - protein, 382 aa, Homo sapiens
MELREEAWSPGPLDSEDQQMASHENPVDILIMDDDDVPSWPPTKLSPPQSAPPAGPPPRPRPPAPYICNECGKSFSHWSKLTRHQRTHTGERPNACADCGKTFSQSSHLVQHRRIHTGEKPYACLECGKRFSWSSNLMQHQRIHTGEKPYTCPDCGRSFTQSKSLAKHRRSHSGLKPFVCPRCGRGFSQPKSLARHLRLHPELSGPGVAAKVLAASVRRAKGPEEAVAADGEIAIPVGDGEGIIVVGAPGEGAAAAAAMAGAGAKAAGPRSRRAPAPKPYVCLECGKGFGHGAGLLAHQRAQHGDGLGAAGGEEPAHICVECGEGFVQGAALRRHKKIHAVGAPSVCSSCGQSYYRAGGEEEDDDDEAAGGRCPECRAGEGR

SEQ ID NO: 753098 - protein, 382 aa, Homo sapiens; identical to SEQ ID NO: 753097

SEQ ID NO: 753099 - protein, 124 aa, Homo sapiens [sequence omitted]

SEQ ID NO: 753100 - protein, 382 aa, Homo sapiens; identical to SEQ ID NO: 753097

SEQ ID NO: 753101 - protein, 382 aa, Homo sapiens; identical to SEQ ID NO: 753097

SEQ ID NO: 753102 - protein, 164 aa, Homo sapiens
NDLPAAAAATWCPQVPAGVLGPAGLDVRQHAGTVQVAALQRGLSVPERVRAGARARGSPAASECQVSRARGPTAAHRPAQIPAFFVQVMVWFPGGAFIVGAASSYEGSDLAAREKVVLVFLQHRLGIFGFLRWRGRYPLGPQLWPERRGLGGKGGAGPGAGMGG

SEQ ID NO: 753103 - protein, 290 aa, Homo sapiens
TISPRPPPLPGARRCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYVSE

SEQ ID NO: 753104 - protein, 233 aa, Homo sapiens
MLSFTRLAYILPAHESLGTLQISIGKMIEDMIRFNETFQFLFWTMFGMEEHSVVDVPQFLVPEFAGRALYGIFTIIMVIVLLNMLIAMITNSFQKIEDDADVEWTFARSKLYLFYFSEGLTLPVPFNILPSSKAVFYLLRRICQFICCCCSCCKTKKPDYPPIPTFANPRAGAVPGEGERGSYRLHVIKALVQRYTETARREFEETRRKDLGNRLTELTKTISRLQSEVAGVR

SEQ ID NO: 753105 - protein, 182 aa, Homo sapiens
SAPVGPVAGGIMGCIMVLVLAVYAYRHQIHRRSHQHMSPLAAQEMSVRMSNLENDRDERDDDSHEDRGIISNTRFIAAVIERHAHSPERRRRYWGRSGTESDHGYSTMSPQEDSENPPCNNDPLSAGVDVGNHDEDLDLDTPPQTAALLSHKFHHYRSHHPTLHHSHHLQAAVTVHTVDAEC

SEQ ID NO: 753106 - protein, 182 aa, Homo sapiens; identical to SEQ ID NO: 753105

SEQ ID NO: 753107 - protein, 182 aa, Homo sapiens; identical to SEQ ID NO: 753105

SEQ ID NO: 753108 - protein, 182 aa, Homo sapiens; identical to SEQ ID NO: 753105

SEQ ID NO: 753109 - protein, 182 aa, Homo sapiens; identical to SEQ ID NO: 753105

SEQ ID NO: 753110 - protein, 102 aa, Homo sapiens
KLSAYGADMAKSKNHTTHNQSRKWHRNGIKKPRSQRYESLKGVDPKFLRNMRFAKKHNKKGLKKMQANNAKAMSARAEAIKALVKPKEVKPKIPKGVSHKLD

SEQ ID NO: 753111 - protein, 1099 aa, Homo sapiens
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKPGDGAIAVDELQDNKKLKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQESRKFFVFTFLGSIMWIAMFSYLMVWWAHQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 753112 - protein, 1081 aa, Homo sapiens
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQESRKFFVFTFLGSIMWIAMFSYLMVWWAHQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 753113 - protein, 1081 aa, Homo sapiens; identical to SEQ ID NO: 753112

SEQ ID NO: 753114 - protein, 985 aa, Homo sapiens [sequence omitted]

SEQ ID NO: 753115 - protein, 1081 aa, Homo sapiens; identical to SEQ ID NO: 753112

SEQ ID NO: 753116 - protein, 985 aa, Homo sapiens [sequence omitted]

SEQ ID NO: 753117 - protein, 1056 aa, Homo sapiens
KKKKKKKRKKKKEEEEEEEEGAEKSSSPFAAAMGEDDAALRAGSRGLSDPWADSVGVRPRTTERHIAVHKRLVLAFAVSLVALLAVTMLAVLLSLRFDECGASATPGADGGPSGFPERGGNGSLPGSARRNHHAGGDSWQPEAGGVASPGTTSAQPPSEEEREPWEPWTQLRLSGHLKPLHYNLMLTAFMENFTFSGEVNVEIACRNATRYVVLHASRVAVEKVQLAEDRAFGAVPVAGFFLYPQTQVLVVVLNRTLDAQRNYNLKIIYNALIENELLGFFRSSYVLHGERRFLGVTQFSPTHARKAFPCFDEPIYKATFKISIKHQATYLSLSNMPVETSVFEEDGWVTDHFSQTPLMSTYYLAWAICNFTYRETTTKSGVVVRLYARPDAIRRGSGDYALHITKRLIEFYEDYFKVPYSLPKLDLLAVPKHPYAAMENWGLSIFVEQRILLDPSVSSISYLLDVTMVIVHEICHQWFGDLVTPVWWEDVWLKEGFAHYFEFVGTDYLYPGWNMEKQRFLTDVLHEVMLLDGLASSHPVSQEVLQATDIDRVFDWIAYKKGAALIRMLANFMGHSVFQRGLQDYLTIHKYGNAARNDLWNTLSEALKRNGKYVNIQEVMDQWTLQMGYPVITILGNTTAENRIIITQQHFIYDISAKTKALKLQNNSYLWQIPLTIVVGNRSHVSSEAIIWVSNKSEHHRITYLDKGSWLLGNINQTGYFRVNYDLRNWRLLIDQLIRNHEVLSVSNRAGLIDDAFSLARAGYLPQNIPLEIIRYLSEEKDFLPWHAASRALYPLDKLLDRMENYNIFNEYILKQVATTYIKLGWPKNNFNGSLVQASYQHEELRREVIMLACSFGNKHCHQQASTLISDWISSNRNRIPLNVRDIVYCTGVSLLDEDVWEFIWMKFHSTTAVSEKKILLEALTCSDDRNLLNRLLNLSLNSEVVLDQDAIDVIIHVARNPHGRDLAWKFFRDKWKILNTRYGEALFMNSKLISGVTEFLNTEGELKELKNFMKNYDGVAAASFSRAVETVEANVRWKMLYQDELFQWLGKALRH

SEQ ID NO: 753118 - protein, 1001 aa, Homo sapiens
MGPRAPYQVPGKPPKRLVLAFAVSLVALLAVTMLAVLLSLRFDECGASATPGADGGPSGFPERGGNGSLPGSARRNHHAGGDSWQPEAGGVASPGTTSAQPPSEEEREPWEPWTQLRLSGHLKPLHYNLMLTAFMENFTFSGEVNVEIACRNATRYVVLHASRVAVEKVQLAEDRAFGAVPVAGFFLYPQTQVLVVVLNRTLDAQRNYNLKIIYNALIENELLGFFRSSYVLHGERRFLGVTQFSPTHARKAFPCFDEPIYKATFKISIKHQATYLSLSNMPVETSVFEEDGWVTDHFSQTPLMSTYYLAWAICNFTYRETTTKSGVVVRLYARPDAIRRGSGDYALHITKRLIEFYEDYFKVPYSLPKLDLLAVPKHPYAAMENWGLSIFVEQRILLDPSVSSISYLLDVTMVIVHEICHQWFGDLVTPVWWEDVWLKEGFAHYFEFVGTDYLYPGWNMEKQRFLTDVLHEVMLLDGLASSHPVSQEVLQATDIDRVFDWIAYKKGAALIRMLANFMGHSVFQRGLQDYLTIHKYGNAARNDLWNTLSEALKRNGKYVNIQEVMDQWTLQMGYPVITILGNTTAENRIIITQQHFIYDISAKTKALKLQNNSYLWQIPLTIVVGNRSHVSSEAIIWVSNKSEHHRITYLDKGSWLLGNINQTGYFRVNYDLRNWRLLIDQLIRNHEVLSVSNRAGLIDDAFSLARAGYLPQNIPLEIIRYLSEEKDFLPWHAASRALYPLDKLLDRMENYNIFNEYILKQVATTYIKLGWPKNNFNGSLVQASYQHEELRREVIMLACSFGNKHCHQQASTLISDWISSNRNRIPLNVRDIVYCTGVSLLDEDVWEFIWMKFHSTTAVSEKKILLEALTCSDDRNLLNRLLNLSLNSEVVLDQDAIDVIIHVARNPHGRDLAWKFFRDKWKILNTRYGEALFMNSKLISGVTEFLNTEGELKELKNFMKNYDGVAAASFSRAVETVEANVRWKMLYQDELFQWLGKALRH

SEQ ID NO: 753119 - protein, 437 aa, Homo sapiens
MDQWTLQMGYPVITILGNTTAENRIIITQQHFIYDISAKTKALKLQNNSYLWQIPLTIVVGNRSHVSSEAIIWVSNKSEHHRITYLDKGSWLLGNINQTGYFRVNYDLRNWRLLIDQLIRNHEVLSVSNRAGLIDDAFSLARAGYLPQNIPLEIIRYLSEEKDFLPWHAASRALYPLDKLLDRMENYNIFNEYILKQVATTYIKLGWPKNNFNGSLVQASYQHEELRREVIMLACSFGNKHCHQQASTLISDWISSNRNRIPLNVRDIVYCTGVSLLDEDVWEFIWMKFHSTTAVSEKKILLEALTCSDDRNLLNRLLNLSLNSEVVLDQDAIDVIIHVARNPHGRDLAWKFFRDKWKILNTRYGEALFMNSKLISGVTEFLNTEGELKELKNFMKNYDGVAAASFSRAVETVEANVRWKMLYQDELFQWLGKALRH

SEQ ID NO: 753120 - protein, 764 aa, Homo sapiens
KKKKKKKRKKKKEEEEEEEEGAEKSSSPFAAAMGEDDAALRAGSRGLSDPWADSVGVRPRTTERHIAVHKRLVLAFAVSLVALLAVTMLAVLLSLRFDECGASATPGADGGPSGFPERGGNGSLPGSARRNHHAGGDSWQPEAGGVASPGTTSAQPPSEEEREPWEPWTQLRLSGHLKPLHYNLMLTAFMENFTFSGEVNVEIACRNATRYVVLHASRVAVEKVQLAEDRAFGAVPVAGFFLYPQTQVLVVVLNRTLDAQRNYNLKIIYNALIENELLGFFRSSYVLHGERRFLGVTQFSPTHARKAFPCFDEPIYKATFKISIKHQATYLSLSNMPVETSVFEEDGWVTDHFSQTPLMSTYYLAWAICNFTYRETTTKSGVVVRLYARPDAIRRGSGDYALHITKRLIEFYEDYFKVPYSLPKLDLLAVPKHPYAAMENWGLSIFVEQRILLDPSVSSISYLLDVTMVIVHEICHQWFGDLVTPVWWEDVWLKEGFAHYFEFVGTDYLYPGWNMEKQRFLTDVLHEVMLLDGLASSHPVSQEVLQATDIDRVFDWIAYKKGAALIRMLANFMGHSVFQRGLQDYLTIHKYGNAARNDLWNTLSEALKRNGKYVNIQEVMDQWTLQMGYPVITILGNTTAENRIIITQQHFIYDISAKTKALKLQNNSYLWQIPLTIVVGNRSHVSSEAIIWVSNKSEHHRITYLDKGSWLLGNINQTGYFRVNYDLRNWRLLIDQLIRNHEVLSVSNRAGLIDDAFSLASLYI

SEQ ID NO: 753121 - protein, 122 aa, Homo sapiens
RDTSRPGGVVGADRAPLPLQGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 753122 - protein, 193 aa, Homo sapiens
MARARQEGSSPEPVEGLARDGPRPFPLGRLVPSAVSCGLCEPGLAAAPAAPTLLPAAYLCAPTAPPAVTAALGGSRWPGGPRSRPRGPRPDGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 753123 - protein, 193 aa, Homo sapiens; identical to SEQ ID NO: 753122

SEQ ID NO: 753124 - protein, 101 aa, Homo sapiens
MKFGMGSAQACPCQVPRAASTTWVPCQICETRGAAAAPPLTLEGPVQSHHGTPALTQGPQSPRDGAQLGACTRPVDVRDSGGRPLPPPDTLASAGDFLCTM

SEQ ID NO: 753125 - protein, 190 aa, Homo sapiens
RREPHASGRLAAAAAAPAIPAAATTRTRLRPGEQQQPQPQQPPLQLERQQQRQPQQQPPRRAALGGRALLKEAARPPPPPPPACSCPRGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 753126 - protein, 193 aa, Homo sapiens; identical to SEQ ID NO: 753122

SEQ ID NO: 753127 - protein, 131 aa, Homo sapiens
MKFGMGSAQACPCQVPRAASTTWVPCQICGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 753128 - protein, 193 aa, Homo sapiens; identical to SEQ ID NO: 753122

SEQ ID NO: 753129 - protein, 96 aa, Homo sapiens
MGLPNSVSFAITATFLALSSFWIKRKAPEPSLTCRLPTQTEVSDEKSLGAVPLPWDPGAEHPDTKMPGECQEACTKGCSGHPSWPSARLQGLGPRT

SEQ ID NO: 753130 - protein, 1503 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTARALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 753131 - protein, 1455 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTIKKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTARALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGENPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 753132 - protein, 1494 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTARALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLSSP

SEQ ID NO: 753133 - protein, 1469 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTARALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGENPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 753134 - protein, 331 aa, Homo sapiens
GPKVWCASSSAASSFRVDAMVDLLDLDPLKRSGSMEQRLASLEEQVAQTARALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGENPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 753135 - protein, 107 aa, Homo sapiens
ITGSTTIIKLTTGSTKAAPQDKAALLPGGDPDTPQTEPQVPEESAEAVSPSSPWYLEPSRVVRSSPISALRWMGWIPLTWLPSPPWPETFRRKQKDEMGLASRRGRE

SEQ ID NO: 753136 - protein, 927 aa, Homo sapiens
RVLSLESPLEKDPRVLGAQSVPRGRALKGLSPLGLDSAFRLFPDPRAGPWNTAVLSSGMEPETALWGPDLQGPEQSPNDAHRGAESENEEESPRQESSGEEIIMGDPAQSPESKDSTEMSLERSSQDPSVPQNPPTPLGHSNPLDHQIPLDPPAPEVVPTPSDWTKACEASWQWGALTTWNSPPVVPANEPSLRELVQGRPAGAEKPYICNECGKSFSQWSKLLRHQRIHTGERPNTCSECGKSFTQSSHLVQHQRTHTGEKPYKCPDCGKCFSWSSNLVQHQRTHTGEKPYKCTECEKAFTQSTNLIKHQRSHTGEKPYKCGECRRAFYRSSDLIQHQATHTGEKPYKCPECGKRFGQNHNLLKHQKIHAGEKPYRCTECGKSFIQSSELTQHQRTHTGEKPYECLECGKSFGHSSTLIKHQRTHLREDPFKCPVCGKTFTLSATLLRHQRTHTGERPYKCPECGKSFSVSSNLINHQRIHRGERPYICADCGKSFIMSSTLIRHQRIHTGEKPYKCSDCGKSFIRSSHLIQHRRTHTGEKPYKCPECGKSFSQSSNLITHVRTHMDENLFVCSDCGKAFLEAHELEQHRVIHERGKTPARRAQGDSLLGLGDPSLLTPPPGAKPHKCLVCGKGFNDEGIFMQHQRIHIGENPYKNADGLIAHAAPKPPQLRSPRLPFRGNSYPGAAEGRAEAPGQPLKPPEGQEGFSQRRGLLSSKTYICSHCGESFLDRSVLLQHQLTHGNEKPFLFPDYRIGLGEGAGPSPFLSGKPFKCPECKQSFGLSSELLLHQKVHAGGKSSQKSPELGKSSSVLLEHLRSPLGARPYRCSDCRASFLDRVALTRHQETHTQEKPPNPEDPPPEAVTLSTDQEGEGETPTPTESSSHGEGQNPKTLVEEKPYLCPECGAGFTEVAALLLHRSCHPGVSL

SEQ ID NO: 753137 - protein, 927 aa, Homo sapiens; identical to SEQ ID NO: 753136

SEQ ID NO: 753138 - protein, 176 aa, Homo sapiens
RGRSRAAAAAAAARGAAALVQTGKMAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALSKCLFLS

SEQ ID NO: 753139 - protein, 430 aa, Homo sapiens
RGRSRAAAAAAAARGAAALVQTGKMAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALSTTFKTQKQLKENLNKQPNKQWKKSQTSTNPKAALKSKIVAEFRSQALIEELLLYKRSEDQIELKEKQLSTMRVDVCSTETLKCLKDKTGGKKFSKEFEEASSKLEEFVNGLDKQVKNGPSLTEALENAGIFYEAQYKEVKVVANAYKTFANRVNNLKKKLDQLKSTLPDPEESPVPSPSMDAPSPTGSESPFQGMGGEESQSPTVESEKSATPEPVTDNRDVEDMELSDVEDDGSKIIVEDRKEKPAEKSAVSTSVPTKP

SEQ ID NO: 753140 - protein, 404 aa, Homo sapiens
RGRSRAAAAAAAARGAAALVQTGKMAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALTSTNPKAALKSKIVAEFRSQALIEELLLYKRSEDQIELKEKQLSTMRVDVCSTETLKCLKDKTGGKKFSKEFEEASSKLEEFVNGLDKQVKNGPSLTEALENAGIFYEAQYKEVKVVANAYKTFANRVNNLKKKLDQLKSTLPDPEESPVPSPSMDAPSPTGSESPFQGMGGEESQSPTVESEKSATPEPVTDNRDVEDMELSDVEDDGSKIIVEDRKEKPAEKSAVSTSVPTKP

SEQ ID NO: 753141 - protein, 410 aa, Homo sapiens
MTATPPLPKPVNTSLSPSPALALPNLANVDLAKISSILSSLTSVMKNTGVSPASRPSPGTPTSPSNLTSGLKTPAPATTTSHNPLANILSKVEITPESILSALSKTQTQSAPALQGLSSLLQSVTGNPVPASEAASQSTSASPANTTVSTIKGRNLPPVPSLLFPKASTYSPNSSNSEVSSTFSQQGPNWAKPRAPKHLLLNYLQLFGVSSYPDNKPAAPPTEVTICQSSEVSKPKLESESNSPSLEMKIHNFLQGNPGFSGLNLNIPILSSLGVQRPIKRAIPQYFQRGLLALNRNIDGTPVKDERMGNQPGGDDDRPISKWILSPGDQRPIDRVLKNQGTEEHPVEKKDTKAPTDQIEPGGRIQKAPGRDNYRKAQTHQSQERHKRSATEEKDQEATAGRDDDTHHKQ

SEQ ID NO: 753142 - protein, 430 aa, Homo sapiens; identical to SEQ ID NO: 753139

SEQ ID NO: 753143 - protein, 202 aa, Homo sapiens
RGRSRAAAAAAAARGAAALVQTGKMAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALSTTFKTQKQLKENLNKQPNKQWKKSQSKEQNLN

SEQ ID NO: 753144 - protein, 185 aa, Homo sapiens
ITGVSSTWCRFHTLWGRALSGKEETRKIPVPANRYTPLKENWMKIFTPIVEHLGLQIRFNLKSRNVEIRTCKETKDVSALTKAADFVKAFILGFQVEDALALIRLDDLFLESFEITDVKPLKGDHLSRAIGRIAGKGGKTKFTIENVTRTRIVLADVKVHILAPSKYQMLHSIATKWERDPLDRP

SEQ ID NO: 753145 - protein, 252 aa, Homo sapiens
MESEMETQSARAEEGFTQVTRKGGRRAKKRQAEQLSAAGEGGDAGRMDTEEARPAKRPVFPPLCGDGLLSGKEETRKIPVPANRYTPLKENWMKIFTPIVEHLGLQIRFNLKSRNVEIRTCKETKDVSALTKAADFVKAFILGFQVEDALALIRLDDLFLESFEITDVKPLKGDHLSRAIGRIAGKGGKTKFTIENVTRTRIVLADVKVHILGSFQNIKMARTAICNLILGNPPSKVYGNIRAVASRSADRF

SEQ ID NO: 753146 - protein, 252 aa, Homo sapiens; identical to SEQ ID NO: 753145

SEQ ID NO: 753147 - protein, 252 aa, Homo sapiens; identical to SEQ ID NO: 753145

SEQ ID NO: 753148 - protein, 252 aa, Homo sapiens; identical to SEQ ID NO: 753145

SEQ ID NO: 753149 - protein, 69 aa, Homo sapiens
METQSARAEEGFTQVTRKGGRRAKKRQAEQLSYFYFWIGDVYFFFYYYYTLNSRVHVHNVQVTYVYMCH

SEQ ID NO: 753150 - protein, 252 aa, Homo sapiens; identical to SEQ ID NO: 753145

SEQ ID NO: 753151 - protein, 202 aa, Homo sapiens
ITGVSSTWCRFHTLWGRALSGKEETRKIPVPANRYTPLKENWMKIFTPIVEHLGLQIRFNLKSRNVEIRTCKETKDVSALTKAADFVKAFILGFQVEDALALIRLDDLFLESFEITDVKPLKGDHLSRAIGRIAGKGGKTKFTIENVTRTRIVLADVKVHILGSFQNIKMARTAICNLILGNPPSKVYGNIRAVASRSADRF

SEQ ID NO: 753152 - protein, 285 aa, Homo sapiens
MIPWVLLACALPCAADPLLGAFARRDFRKGSPQLVCSLPGPQGPPGPPGAPGPSGMMGRMGFPGKDGQDGHDGDRGDSGEEGPPGRTGNRGKPGPKGKAGAIGRAGPRGPKGVNGTPGKHGTPGKKGPKGKKGEPGLPGPCSCGSGHTKSAFSVAVTKSYPRERLPIKFDKILMNEGGHYNASSGKFVCGVPGIYYFTYDITLANKHLAIGLVHNGQYRIRTFDANTGNHDVASGSTILALKQGDEVWLQIFYSEQNGLFYDPYWTDSLFTGFLIYADQDDPNEV

SEQ ID NO: 753153 - protein, 216 aa, Homo sapiens
MIPWVLLACALPCAADPLLGAFARRDFRKGSPQLVCSLPGPQGPPGPPGAPGPSGMMGRMGFPGKDGQDGHDGDRGDSGEEAFSVAVTKSYPRERLPIKFDKILMNEGGHYNASSGKFVCGVPGIYYFTYDITLANKHLAIGLVHNGQYRIRTFDANTGNHDVASGSTILALKQGDEVWLQIFYSEQNGLFYDPYWTDSLFTGFLIYADQDDPNEV

SEQ ID NO: 753154 - protein, 182 aa, Homo sapiens
MGFPGKDGQDGHDAGKHGTPGKKGPKGKKGEPGLPGPCSCGSGHTKSAFSVAVTKSYPRERLPIKFDKILMNEGGHYNASSGKFVCGVPGIYYFTYDITLANKHLAIGLVHNGQYRIRTFDANTGNHDVASGSTILALKQGDEVWLQIFYSEQNGLFYDPYWTDSLFTGFLIYADQDDPNEV

SEQ ID NO: 753155 - protein, 91 aa, Homo sapiens
EQITRVECHQLRQEPAIFTSFVVLQLPQAIWMYSCRPGLRGLTETCTQRRELTSAKAHTSLNKIPVPPCWPPPSGGFCSVSHWLCDIISFL

SEQ ID NO: 753156 - protein, 200 aa, Homo sapiens
WELSWAWPVCVRLLDLGTASRLGTGLGGGADLGLGGPGSRRRPRPQDPAGRTPSPASAARCSSAGRGQVPPSRLSSLLFSSSSTSVPAETPAAPFRRGVVICGADSSPAATLPEVSGSGTSSGRRSPGGPTVGPEEPALLPHPNLEHLTFGCWRGQARGWLDSCGAARASCLETVGCTPGLLALPLGSRGVHIRRMLTET

SEQ ID NO: 753157 - protein, 666 aa, Homo sapiens
MDVCVRLALWLLWGLLLHQGQSLSHSHSEKATGTSSGANSEESTAAEFCRIDKPLCHSEDEKLSFEAVRNIHKLMDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 753158 - protein, 522 aa, Homo sapiens
GVEDRFNPNRPEAAAQWHAMPRLAVTNTTMTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 753159 - protein, 245 aa, Homo sapiens
PLLSYTYGCSTSVYSSFLSPSHLPVHPISLSCRSIPIFLPCPCLLVLSLSPLRLSPITSSNICPFLPLCPMSCRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 753160 - protein, 685 aa, Homo sapiens
MDVCVRLALWLLWGLLLHQGQSLSHSHSEKATGTSSGANSEESTAAEFCRIDKPLCHSEDEKLSFEAVRNIHKLMDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDEINLAKQEAQRLKELREGTENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 753161 - protein, 493 aa, Homo sapiens [sequence omitted]

SEQ ID NO: 753162 - protein, 83 aa, Homo sapiens
CSGVCKAKCAVGTLTHHALPSLAVTRHNHLKDFMLVVSIVIGVGGCWFAYIQNRYSKEHMKKMMKDLEGLHRAEQSLHDLQER

SEQ ID NO: 753163 - protein, 685 aa, Homo sapiens; identical to SEQ ID NO: 753160

SEQ ID NO: 753164 - protein, 685 aa, Homo sapiens; identical to SEQ ID NO: 753160

SEQ ID NO: 753165 - protein, 685 aa, Homo sapiens; identical to SEQ ID NO: 753160

SEQ ID NO: 753166 - protein, 685 aa, Homo sapiens; identical to SEQ ID NO: 753160

SEQ ID NO: 753167 - protein, 685 aa, Homo sapiens; identical to SEQ ID NO: 753160

SEQ ID NO: 753168 - protein, 76 aa, Homo sapiens
ELPTHGYKLRHQTQGRPRPPRTTPPGPGRPSMPAPGTRQENGMATRLDEGLEDFFSRRVMEESSSYPRTLRTVRPG

SEQ ID NO: 753169 - protein, 68 aa, Homo sapiens
ELPTHGYKLRHQTQGRPRPPRTTPPGPGRPSMPAPGTRQENGMATRLDEGLEDFFSRRVMEESSRCDA

SEQ ID NO: 753170 - protein, 338 aa, Homo sapiens
AYSRCGLPRVTAGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCFVSFFDLRDPSQIDNNEPYMKIPCNDSKITSAVWGPLGECIIAGHESGELNQYSAKSGEVLVNVKEHSRQINDIQLSRDMTMFVTASKDNTAKLFDSTTLEHQKTFRTERPVNSAALSPNYDHVVLGGGQEAMDVTTTSTRIGKFEARFFHLAFEEEFGRVKGHFGPINSVAFHPDGKSYSSGGEDGYVRIHYFDPQYFEFEFEA

SEQ ID NO: 753171 - protein, 83 aa, Homo sapiens
GQAFLADHLPLWLQPLWLLPPQLLLLLLLPCLRYSSLPDSSLPFPLLRSSPSLTGQLTFCLHHKALSLFKKHIQLTALSASRS

SEQ ID NO: 753172 - protein, 360 aa, Homo sapiens
MPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPPLAPVLLRKPSLAKALQAGPLKKDGPMQITVKDLLTVKLKKTQSLDEKRKLIPSPKARNPLVTVSDLQHVTLKPNSKVLSTRVTNVLITPGKSQMDLRKLLRKVDVERSPGGTPLTNKENMETGTGLTPVMTQALRRKFQLAHPRSPTPTLPLSTSSFDEQN

SEQ ID NO: 753173 - protein, 360 aa, Homo sapiens; identical to SEQ ID NO: 753172

SEQ ID NO: 753174 - protein, 360 aa, Homo sapiens; identical to SEQ ID NO: 753172

SEQ ID NO: 753175 - protein, 360 aa, Homo sapiens; identical to SEQ ID NO: 753172

SEQ ID NO: 753176 - protein, 360 aa, Homo sapiens; identical to SEQ ID NO: 753172

SEQ ID NO: 753177 - protein, 360 aa, Homo sapiens; identical to SEQ ID NO: 753172

SEQ ID NO: 753178 - protein, 369 aa, Homo sapiens
MPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPPLAPVLLRKPSLAKALQAGPLKKDGPMQITVKDLLTVKLKKTQSLDEKRKLIPSPKARNPLVTVSDLQHVTLKPNSKVLSTRVTNVLITPGKSQMDLRKLLRKVDVERSPGGTPLTNKENMETGTGLTPVMTQALRRKFQLAHPRSPTPTTATPAWVTEQETLSQKKKKKN

SEQ ID NO: 753179 - protein, 360 aa, Homo sapiens; identical to SEQ ID NO: 753172

SEQ ID NO: 753180 - protein, 312 aa, Homo sapiens
MPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPPLAPVLLRKPSLAKALQAGPLKKDGPMQITVKDLLTVKLKKTQSLDEKRKLIPSPKARNPLVTVSDLQHVTLKPNSKVLSTRVTNVLITPGKSQMDLRGRELVEGRLVEGRLVE

SEQ ID NO: 753181 - protein, 360 aa, Homo sapiens; identical to SEQ ID NO: 753172

SEQ ID NO: 753182 - protein, 377 aa, Homo sapiens
RATARTPSTPPALETKIMPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPPLAPVLLRKPSLAKALQAGPLKKDGPMQITVKDLLTVKLKKTQSLDEKRKLIPSPKARNPLVTVSDLQHVTLKPNSKVLSTRVTNVLITPGKSQMDLRKLLRKVDVERSPGGTPLTNKENMETGTGLTPVMTQALRRKFQLAHPRSPTPTLPLSTSSFDEQN

SEQ ID NO: 753183 - protein, 360 aa, Homo sapiens; identical to SEQ ID NO: 753172

SEQ ID NO: 753184 - protein, 360 aa, Homo sapiens; identical to SEQ ID NO: 753172

SEQ ID NO: 753185 - protein, 350 aa, Homo sapiens
MPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPPLAPVLLRKPSLAKALQAGPLKKDGPMQITVKDLLTVKLKKTQSLDEKRKLIPSPKARNPLVTVSDLQHVTLKPNSKVLSTRVTNVLITPGKSQMDLRKLLRKVDVERSPGGTPLTNKENMETGTGLTPVMTQALRRKFQLPGSSNSPASAS

SEQ ID NO: 753186 - protein, 286 aa, Homo sapiens [sequence omitted]

SEQ ID NO: 753187 - protein, 141 aa, Homo sapiens
MHILLFGLDAAGKMTILYKLKLGEIVTTIPTTGFNVETVEYKNTCFTVRDVGGQDRIRPLWKHYFQNTQGLIFVVDSNDRGRIQEVADELQKMLLVDELRDAVLLLFANKQDLPNDMAVSEMTDAAENLETTFFDTRPDPA

SEQ ID NO: 753188 - protein, 117 aa, Homo sapiens
MPWLGARVIAGTSVSSVVIAVSALRVLGPVLVKTDLVGDADDGGGCEWWGWELQTLHCSFFFFETQFHFCCPGQSATVRSQLTANSTSQVQAILLPQPPEVLGLQAYATTPGSKRVL

SEQ ID NO: 753189 - protein, 70 aa, Homo sapiens
GNNALEPMPAALLQAAHTVPSLKELSHMGYRDEGLGGNKSRCALRPHAPAPKPRLALSFSLCCSAFVRLL

SEQ ID NO: 753190 - protein, 756 aa, Homo sapiens
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKDVELPKAPIFLSSTFNYNGSTLAAVHATPRGLRSRERTTWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYRIQIHSPLGIHIPLESDMERALSWGRYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 753191 - protein, 43 aa, Homo sapiens
PRDLTWCGTHLLSLPLAGLKNWVVAEDVVFKPVAAPWNPEHWL

SEQ ID NO: 753192 - protein, 729 aa, Homo sapiens [sequence omitted]

SEQ ID NO: 753193 - protein, 726 aa, Homo sapiens
MEGERKNNNKRWYFTREQLENSPSRRFGVDPDKELSYRQQAANLLQDMGQRLNVSQLTINTAIVYMHRFYMIQSFTQFPGNSVAPAALFLAAKVEEQPKKLEHVIKVAHTCLHPQESLPDTRSEAYLQQVQDLVILESIILQTLGFELTIDHPHTHVVKCTQLVRASKDLAQTSYFMATNSLHLTTFSLQYTPPVVACVCIHLACKWSNWEIPVSTDGKHWWEYVDATVTLELLDELTHEFLQILEKTPNRLKRIWNWRACEAAKKTKADDRGTDEKTSEQTILNMISQSSSDTTIAGLMSMSTSTTSAVPSLPVSEESSSNLTSVEMLPGKRWLSSQPSFKLEPTQGHRTSENLALTGVDHSLPQDGSNAFISQKQNSKSVPSAKVSLKEYRAKHAEELAAQKRQLENMEANVKSQYAYAAQNLLSHHDSHSSVILKMPIEGSENPERPFLEKADKTALKMRIPVAGGDKAASSKPEEIKMRIKVHAAADKHNSVEDSVTKSREHKEKHKTHPSNHHHHHNHHSHKHSHSQLPVGTGNKRPGDPKHSSQTSNLAHKTYSLSSSFSSSSSTRKRGPSEETGGAVFDHPAKIAKSTKSSSLNFSFPSLPTMGQMPGHSSDTSGLSFSQPSCKTRVPHSKLDKGPTGANGHNTTQTIDYQDTVNMLHSLLSAQGVQPTQPTAFEFVRPYSDYLNPRSGGISSRSGNTDKPRPPPLPSEPPPPLPPLPK

SEQ ID NO: 753194 - protein, 127 aa, Homo sapiens
MEGERKNNNKRWYFTREQLENSPSRRFGVDPDKELSYRQQAANLLQDMGQRLNVSQLTINTAIVYMHRFYMIQSFTQFPGNSVAPAALFLAAKVEEQPKKLEHVIKVAHTCLHPQESLPDTRSEVGD

SEQ ID NO: 753195 - protein, 726 aa, Homo sapiens; identical to SEQ ID NO: 753193

SEQ ID NO: 753196 - protein, 153 aa, Homo sapiens
SVEMLPGKRWLSSQPSFKLEPTQGHRTSENLALTGVDHSLPQDGSNAFISQKQNSKSVPSAKVSLKEYRAKHAEELAAQKRQLENMEANVKSQYAYAAQNLLSHHDSHSSVILKMPIEGSENPERPFLEKADKTALKMRIPVAGGDKAASSKP

SEQ ID NO: 753197 - protein, 519 aa, Homo sapiens
KHSDKIGETAMKQAQHQKTFSVSLQKQNKMKFGKNMYINRDRIPEERNETVLKHSLEEEDENEEEILTVQDLVDFSPVYRCLHIYSVLGDEETFENYYRKQRKKQARLVLQPQSNMHETVDGYRRYFTQIVGFFVVEDHILHVTQGLVTRAYTDELWNMALSKIIAVLRAHSSYCTDPDLVLELKNLTVIFADTLQGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCEYEVLLCCPDWSQTPGLKSSSCLGIPKCWN

SEQ ID NO: 753198 - protein, 519 aa, Homo sapiens; identical to SEQ ID NO: 753197

SEQ ID NO: 753199 - protein, 166 aa, Homo sapiens
QPSSLCLEWGKKKGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 753200 - protein, 596 aa, Homo sapiens
KHSDKIGETAMKQAQHQKTFSVSLQKQNKMKFGKNMYINRDRIPEERNETVLKHSLEEEDENEEEILTVQDLVDFSPVYRCLHIYSVLGDEETFENYYRKQRKKQARLVLQPQSNMHETVDGYRRYFTQIVGFFVVEDHILHVTQGLVTRAYTDELWNMALSKIIAVLRAHSSYCTDPDLVLELKNLTVIFADTLQGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 753201 - protein, 165 aa, Homo sapiens
WSPEVWDHAAMSGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 753202 - protein, 209 aa, Homo sapiens
PEGQQALVGSGVSPTRVSFASLASDESSLETSPPDSSQRPSARPASPGSDAEKRKKRRVLFSKAQTLELERRFRQQRYLSAPEREQLASLLRLTPTQVKIWFQNHRYKLKRARAPGAAESPDLAASAELHAAPGLLRRVVVPVLVRDGQPCGGGGGGEVGTAAAQEKCGAPPAAACPLPGYPAFGPGSALGLFPAYQHLASPALVSWNW

SEQ ID NO: 753203 - protein, 305 aa, Homo sapiens
WRPGPRLSKRLGGKSCLYKQRFRCKCANIPAASAWRAPPTPIRRSGVPAAPPFPACPAPASFPSSAMATSGRLSFTVRSLLGLPEQDAQHLPRREPEPRAPQPDPCAAWLDSERGHYPSSDESSLETSPPDSSQRPSARPASPGSDAEKRKKRRVLFSKAQTLELERRFRQQRYLSAPEREQLASLLRLTPTQVKIWFQNHRYKLKRARAPGAAESPDLAASAELHAAPGLLRRVVVPVLVRDGQPCGGGGGGEVGTAAAQEKCGAPPAAACPLPGYPAFGPGSALGLFPAYQHLASPALVSWNW

SEQ ID NO: 753204 - protein, 101 aa, Homo sapiens
QTPLVLSELGRARGECQLLPCLRPTGPGVRHHPDEERLRDGGPGLRLEPPCLVSWPHQLICCGTVSRPLSRVRQVVEKLNGADNLENTRWIAETFFVPRPY

SEQ ID NO: 753205 - protein, 165 aa, Homo sapiens
YFWMYFSGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEVSTHHYLNHLLQDMKMFRILYHLSVLSLLKECQRAIYVYVNYARTEDFFKLERDMKINVD

SEQ ID NO: 753206 - protein, 176 aa, Homo sapiens
WRVASFSSASSSVKSQLQGLMTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEVSTHHYLNHLLQDMKMFRILYHLSVLSLLKECQR

SEQ ID NO: 753207 - protein, 129 aa, Homo sapiens [sequence omitted]

SEQ ID NO: 753208 - protein, 111 aa, Homo sapiens
METAAAAAPGPGWAAEGERRRRRCSRRDRDREQRRRRGPGGDAPRALLAAPRGSSSSSSPPPPARPWSSASSGERPGGPRRRRPRPRPRPPRPRARKRPAGSGSRGEEEEE

SEQ ID NO: 753209 - protein, 562 aa, Homo sapiens
PPAAAPGTPHLLSKTPPLLQVPGHPGASAANALSEQDLIGQDLNSRYLNAQGGPEVVGAGGSARPLAFQFHQHNHQHQHTHQHTHQHFTPYPPGLLPPHGPHMFEKYPGKMEGLFRHNPYTAFPPAVPGLPPGLPPAVSFGSLQGAFQPKSTNPELPPRLGPVPSGLSQKGTQIPDHFRPPLRKPGKWCAMHVRVAYMILRHQEKMKGDSHKLDFRNDLLPCLPGPYGALPPGQELSHPASLFTATGAVHAAANPFTAAPGAHGPFLSPSTHIDPFGRPTSFASLAALSNGAFGGLGSPTFNSGAVFAQKESPGAPPAFASPPDPWGRLHRSPLTFPAWVRPPEAARTPGSDKERPVERREPSITKEEKDRDLPFSRPQLRVSPATPKARAGEEGPRPTKESVRVKEERKEEAAAAAAAAAAAAAAAAAAATGPQGLHLLFERPRPPPFLGPSPPDRCAGFLEPTWLAAPPRLARPPRFYEAGEELTGPGAVAAARLYGLEPAHPLLYSRLAPPPPPAAAPGTPHLLSKTPPGALLGAPPPLVPAPRPSSPPRGPGPARADR

SEQ ID NO: 753210 - protein, 134 aa, Homo sapiens
MEPGNRSLNPHKTKHHMECRVTGRAEVTASREGRGACAWECGSSRGPWGLLRYTFAPVRASRPWACLPKGSLSQRPKCPLPFTYHPSPHALRGLGEEGLKEGGFHVHIYHPFHIAPRPFVHFYRGAPPNSSLPG

SEQ ID NO: 753211 - protein, 589 aa, Homo sapiens
PPAAAPGTPHLLSKTPPLLQVPGHPGASAANALSEQDLIGQDLNSRYLNAQGGPEVVGAGGSARPLAFQFHQHNHQHQHTHQHTHQHFTPYPPGLLPPHGPHMFEKYPGKMEGLFRHNPYTAFPPAVPGLPPGLPPAVSFGSLQGAFQPKSTNPELPPRLGPVPSGLSQKGTQIPDHFRPPLRKPGKWCAMHVRVAYMILRHQEKMKGDSHKLDFRNDLLPCLPGPYGALPPGQELSHPASLFTATGAVHAAANPFTAAPGAHGPFLSPSTHIDPFGRPTSFASLAALSNGAFGGLGSPTFNSGAVFAQKESPGAPPAFASPPDPWGRLHRSPLTFPAWVRPPEAARTPGSDKERPVERREPSITKEEKDRDLPFSRPQLRVSPATPKARAGEEGPRPTKESVRVKEERKEEAAAAAAAAAAAAAAAAAAATGPQGLHLLFERPRPPPFLGPSPPDRCAGFLEPTWLAAPPRLARPPRFYEAGEELTGPGAVAAARLYGLEPAHPLLYSRLAPPPPPAAAPGTPHLLSKTFCTFLQGCPSQQFPSWLIKPSDWCCVPSLWPLCGERGLQGEEPGRDSQASPWEGGASRR

SEQ ID NO: 753212 - protein, 562 aa, Homo sapiens; identical to SEQ ID NO: 753209

SEQ ID NO: 753213 - protein, 562 aa, Homo sapiens; identical to SEQ ID NO: 753209

SEQ ID NO: 753214 - protein, 255 aa, Homo sapiens
PPAAAPGTPHLLSKTPPLLQVPGHPGASAANALSEQDLIGQDLNSRYLNAQGGPEVVGAGGSARPLAFQFHQHNHQHQHTHQHTHQHFTPYPPGLLPPHGPHMFEKYPGKMEGLFRHNPYTAFPPAVPGLPPGLPPAVSFGSLQGAFQPKSTNPELPPRLGPVPSGLSQKGTQIPDHFRPPLRKPGKWCAMHVRVAYMILRHQEKMKGDSHKLDFRNDLLPCLPGPYGALPPGQELSHPASLFTATGESGQPPRA

SEQ ID NO: 753215 - protein, 118 aa, Homo sapiens
TKVPAIELFSSDGGQERMFLAKILLSSVEGQCPELQSSPDSETHSPQPSGPSTFIFSQCLRHVGGEWMLWRCEAPGPGLGSESPPISPLPSPDPRPFPATFEGELCEDLRLHEAGGWC

SEQ ID NO: 753216 - protein, 481 aa, Homo sapiens
TKVPAIELFSSDGGQERMFLAKILLSSVEGQCPELSPPLTLRPTLPSPPAPVPSFSPSVSGMLGVSGCCGDARRLAQDSGLSRLPSLLCHPQIPDHFRPPLRKPGKWCAMHVRVAYMILRHQEKMKGDSHKLDFRNDLLPCLPGPYGALPPGQELSHPASLFTATGAVHAAANPFTAAPGAHGPFLSPSTHIDPFGRPTSFASLAALSNGAFGGLGSPTFNSGAVFAQKESPGAPPAFASPPDPWGRLHRSPLTFPAWVRPPEAARTPGSDKERPVERREPSITKEEKDRDLPFSRPQLRVSPATPKARAGEEGPRPTKESVRVKEERKEEAAAAAAAAAAAAAAAAAAATGPQGLHLLFERPRPPPFLGPSPPDRCAGFLEPTWLAAPPRLARPPRFYEAGEELTGPGAVAAARLYGLEPAHPLLYSRLAPPPPPAAAPGTPHLLSKTPPGALLGAPPPLVPAPRPSSPPRGPGPARADR

SEQ ID NO: 753217 - protein, 134 aa, Homo sapiens; identical to SEQ ID NO: 753210

SEQ ID NO: 753218 - protein, 531 aa, Homo sapiens
PPAAAPGTPHLLSKTPPLLQVPGHPGASAANALSEQDLIGQDLNSRYLNAQGGPEVVGAGGSARPLAFQFHQHNHQHQHTHQHTHQHFTPYPPGLLPPHGPHMFEKYPGKMEGLFRHNPYTAFPPAVPGLPPGLPPAVSFGSLQGAFQPKSTNPELPPRLGPVPSGLSQKGTQIPDHFRPPLRKPGKWCAMHVRVAYMILRHQEKMKGDSHKLDFRNDLLPCLPGPYGALPPGQELSHPASLFTATGAVHAAANPFTAAPGAHGPFLSPSTHIDPFGRPTSFASLAALSNGAFGGLGSPTFNSGAVFAQKESPGAPPAFASPPDPWGRLHRSPLTFPAWVRPPEAARTPGSDKERPVERREPSITKEEKDRDLPFSRPQLRVSPATPKARAGEEGPRPTKESVRVKEERKEEAAAAAAAAAAAAAAAAAAATGPQGLHLLFERPRPPPFLGPSPPDRCAGFLEPTWLAAPPRLARPPRFYEAGEELTGPGAVAAARLYGLEPAHPLLYSRLAPPPPPAAAPGTPHLLSCTQ

SEQ ID NO: 753219 - protein, 449 aa, Homo sapiens
PPAAAPGTPHLLSKTPPLLQVPGHPGASAANALSEQDLIGQDLNSRYLNAQGGPEVVGAGGSARPLAFQFHQHNHQHQHTHQHTHQHFTPYPPGLLPPHGPHMFEKYPGKMEGLFRHNPYTAFPPAVPGLPPGLPPAVSFGSLQGAFQPKSTNPELPPRLGPVPSGLSQKGTQIPDHFRPPLRKPGKWCAMHVRVAYMILRHQEKMKGDSHKLDFRNDLLPCLPGPYGALPPGQELSHPASLFTATGAVHAAANPFTAAPGAHGPFLSPSTHIDPFGRPTSFASLAALSNGAFGGLGSPTFNSGAVFAQKESPGAPPAFASPPDPWGRLHRSPLTFPAWVRPPEAARTPGSDKERPVERREPSITKEEKDRDLPFSRPQLRVSPATPKARAGEEGPRPTKESVRVKEERKEEAAAAAAAAAAAAAAAAAAATGPQGLHLLFERPRPPPT

SEQ ID NO: 753220 - protein, 68 aa, Homo sapiens
LSLKPRLVPVTRCVMVASSALSGVGVGWSGPGQPSHLCLHSCHHRASPVLLFHFLLSVCLRLLPEDIG

SEQ ID NO: 753221 - protein, 574 aa, Homo sapiens [sequence omitted]

SEQ ID NO: 753222 - protein, 103 aa, Homo sapiens
MRPLPLLSLFKGGKRAWKRTRPGKEPEGGWAEPEQPALLPRPGPAGRQDSREGCGLQLIPSQGNCLTLHDFSFIPLIEQSEMQVHQGGRHTSLFCRQEFQTLS

SEQ ID NO: 753223 - protein, 169 aa, Homo sapiens
SFHYNSAELTSPVNMSYNCCSGNFSSRSCGDYLRYPASSRGFSYPSNLVYSTDLCSPSTCQLGSSLYRGCQEICWEPTSCQTSYVESKPLPRPPATAPEPPCSAVLARRLTLGSLGFGSSSCRSLGYGSRKLLLSGLWVQWCQIPGLWKLWLPFPRLWIWILPPNLLGF

SEQ ID NO: 753224 - protein, 1272 aa, Homo sapiens
QTYFNKLKKITKTVQQRYWAMKERNIQFQRYNKLRHSVIYIQAIFRGKKARRHLKMMHIAATLIQRRFRTLMMRRRFLSLKKTAILIQRKYRAHLCTKHHLQFLQVQNAVIKIQSSYRRWMIRKRMREMHRAATFIQSTFRMHRLHMRYQALKQASVVIQQQYQANRAAKLQRQHYLRQRHSAVILQAAFRGMKTRRHLKSMHSSATLIQSRFRSLLVRRRFISLKKATIFVQRKYRATICAKHKLYQFLHLRKAAITIQSSYRRLMVKKKLQEMQRAAVLIQATFRMHRTYITFQTWKHASILIQQHYRTYRAAKLQRENYIRQWHSAVVIQAAYKGMKARQLLREKHKASIVIQSTYRMYRQYCFYQKLQWATKIIQEKYRANKKKQKVFQHNELKKETCVQAGFQDMNIKKQIQEQHQAAIIIQKHCKAFKIRKHYLHIRATVVSIQRRYRKLTAVRTQAVICIQSYYRGFKVRKDIQNMHRAATLIQSFYRMHRAKVDYETKKTAIVVIQNYYRLYVRVKTERKNFLAVQKSVRTIQAAFRGMKVRQKLKNVSEEKMAAIVNQSALCCYRSKTQYEAVQSEGVMIQEWYKASGLACSQEAEYHSQSRAAVTIQKAFCRMVTRKLETQKCAALRIQFFLQMAVYRRRFVQQKRAAITLQHYFRTWQTRKQFLLYRKAAVVLQNHYRAFLSAKHQRQVYLQIRSSVIIIQARSKGFIQKRKFQEIKNSTIKIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 753225 - protein, 1272 aa, Homo sapiens; identical to SEQ ID NO: 753224

SEQ ID NO: 753226 - protein, 1147 aa, Homo sapiens
MIFVPTDFGRNTAYFRGLVLHMRYQALKQASVVIQQQYQANRAAKLQRQHYLRQRHSAVILQAAFRGMKTRRHLKSMHSSATLIQSRFRSLLVRRRFISLKKATIFVQRKYRATICAKHKLYQFLHLRKAAITIQSSYRRLMVKKKLQEMQRAAVLIQATFRMHRTYITFQTWKHASILIQQHYRTYRAAKLQRENYIRQWHSAVVIQAAYKGMKARQLLREKHKASIVIQSTYRMYRQYCFYQKLQWATKIIQEKYRANKKKQKVFQHNELKKETCVQAGFQDMNIKKQIQEQHQAAIIIQKHCKAFKIRKHYLHIRATVVSIQRRYRKLTAVRTQAVICIQSYYRGFKVRKDIQNMHRAATLIQSFYRMHRAKVDYETKKTAIVVIQNYYRLYVRVKTERKNFLAVQKSVRTIQAAFRGMKVRQKLKNVSEEKMAAIVNQSALCCYRSKTQYEAVQSEGVMIQEWYKASGLACSQEAEYHSQSRAAVTIQKAFCRMVTRKLETQKCAALRIQFFLQMAVYRRRFVQQKRAAITLQHYFRTWQTRKQFLLYRKAAVVLQNHYRAFLSAKHQRQVYLQIRSSVIIIQARSKGFIQKRKFQEIKNSTIKIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 753227 - protein, 1222 aa, Homo sapiens
QTYFNKLKKITKTVQQRYWAMKERNIQFQRYNKLRHSVIYIQAIFRGKKARRHLKMMHIAATLIQRRFRTLMMRRRFLSLKKTAILIQRKYRAHLCTKHHLQFLQVQNAVIKIQSSYRRWMIRKRMREMHRAATFIQSTFRMHRLHMRYQALKQASVVIQQQYQANRAAKLQRQHYLRQRHSAVILQAAFRGMKTRRHLKSMHSSATLIQSRFRSLLVRRRFISLKKATIFVQRKYRATICAKHKLYQFLHLRKAAITIQSSYRRLMVKKKLQEMQRAAVLIQATFRMHRTYITFQTWKHASILIQQHYRTYRAAKLQRENYIRQWHSAVVIQAAYKGMKARQLLREKHKASIVIQSTYRMYRQYCFYQKLQWATKIIQEKYRANKKKQKVFQHNELKKETCVQAGFQDMNIKKQIQEQHQAAIIIQKHCKAFKIRKHYLHIRATVVSIQRRYRKLTAVRTQAVICIQSYYRGFKVRKDIQNMHRAATLIQSFYRMHRAKVDYETKKTAIVVIQNYYRLYVRVKTERKNFLAVQKSVRTIQAAFRGMKVRQKLKNVSEEKMAAIVNQSALCCYRSKTQYEAVQSEGVMIQEWYKASGLACSQEAEYHSQSRAAVTIQKAFCRMVTRKLETQKCAALRIQFFLQMAVYRRRFVQQKRAAITLQHYFRTWQTRKQFLLYRKAAVVLQNHYRAFLSAKHQRQVYLQIRSSVIIIQARSKGFIQKRKFQEIKNSTIKIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 753228 - protein, 1272 aa, Homo sapiens; identical to SEQ ID NO: 753224

SEQ ID NO: 753229 - protein, 327 aa, Homo sapiens [sequence omitted]

SEQ ID NO: 753230 - protein, 67 aa, Homo sapiens
LLSGAQLLQGGAVAGESAVRSASSVSGAQLLPGGDGHGFHQQRLALRAGRVHGWPEPISASCLALAA

SEQ ID NO: 753231 - protein, 281 aa, Homo sapiens
MLGPQVWSSVRQGLSRSLSRNVGVWASGEGKKVDIAGIYPPVTTPFTATAEVDYGKLEENLHKLGTFPFRGFVVQGSNGEFPFLTSSERLEVVSRVRQAMPKNRLLLAGSGCESTQATVEMTVSMAQVGADAAMVVTPCYYRGRMSSAALIHHYTKVADLSPIPVVLYSVPANTGLDLPVDAVVTLSQHPNIVGMKDSGGDVTRIGLIVHKTRKQDFQVLAGSAGFLMASYALGAVGGVCALANVLGAQVCQLERLCCTGQWEDAQKLQHRLIEPNAAKIL

SEQ ID NO: 753232 - protein, 164 aa, Homo sapiens
MLGPQVWSSVRQGLSRSLSRNVGVWASGEGKKVDIAGIYPPVTTPFTATAEVDYGKLEENLHKLGTFPFRGAVGGVCALANVLGAQVCQLERLCCTGQWEDAQKLQHRLIEPNAAVTRRFGIPGLKKIMDWFGYYGGPCRAPLQELSPAEEEALRMDFTSNGWL

SEQ ID NO: 753233 - protein, 327 aa, Homo sapiens [sequence omitted]

SEQ ID NO: 753234 - protein, 92 aa, Homo sapiens
GGVCALANVLGAQVCQLERLCCTGQWEDAQKLQHRLIEPNAAVSQWQRGRGLAGGGQSVSSLEQDPGLAPGPTQSLPFRKSFERTSQCGNSL

SEQ ID NO: 753235 - protein, 178 aa, Homo sapiens
LTISSLFSRLFGKKQMRILMVGLDAAGKTTILYKLKLGEIVTTIPTIGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCATQGTGLYEGLDWLSNELSKR

SEQ ID NO: 753236 - protein, 142 aa, Homo sapiens
VSLKFVDKTRSEINKNIVGFSPRYWGMVWRWVQDRIRPLWKHYFQNTQGLIFVVDSNDRERIQEVADELQKMLLVDELRDAVLLLFANKQDLPNAMAISEMTDKLGLQSLRNRTWYVQATCATQGTGLYEGLDWLSNELSKR

SEQ ID NO: 753237 - protein, 655 aa, Homo sapiens
MVLYTTPFPNSCLSALHCVSWALIFPCYWLVDRLAASFIPTTYEKRQRADDPCCLQLLCTALFTPIYLALLVASLPFAFLGFLFWSPLQSARRPYIYSRLEDKGLAGGAALLSEWKGTGPGKSFCFATANVCLLPDSLARVNNLFNTQARAKEIGQRIRNGAARPQIKIYIDSPTNTSISAASFSSLVSPQGGDGVARAVPGSIKRTASVEYKGDGGRHPGDEAANGPASGDPVDSSSPEDACIVRIGGEEGGRPPEADDPVPGGQARNGAGGGPRGQTPNHNQQDGDSGSLGSPSASRESLVKGRAGPDTSASGEPGANSKLLYKASVVKKAAARRRRHPDEAFDHEVSAFFPANLDFLCLQEVFDKRAATKLKEQLHGYFEYILYDVGVYGCQGCCSFKCLNSGLLFASRYPIMDVAYHCYPNKCNDDALASKGALFLKVQVGSTPQDQRIVGYIACTHLHAPQEDSAIRCGQLDLLQDWLADFRKSTSSSSAANPEELVAFDVVCGDFNFDNCSSDDKLEQQHSLFTHYRDPCRLGPGEEKPWAIGTLLDTNGLYDEDVCTPDNLQKVLESEEGRREYLAFPTSKSSGQKGRKELLKGNGRRIDYMLHAEEGLCPDWKAEVEEFSFITQLSGLTDHLPVAMRLMVSSGEEEA

SEQ ID NO: 753238 - protein, 655 aa, Homo sapiens; identical to SEQ ID NO: 753237

SEQ ID NO: 753239 - protein, 655 aa, Homo sapiens; identical to SEQ ID NO: 753237

SEQ ID NO: 753240 - protein, 133 aa, Homo sapiens
MPREPPPLRPPPDLRPGARAVRSREERGALPGADRPPARRQRSAVTALLQREGQQGPSGPSSAPTSQAALGKSFSVITRSPLPSQVLASRVRMCGPQAPAHLPQHQDRDPPTHVSHCGCLWTPGPCVQARPFH

SEQ ID NO: 753241 - protein, 88 aa, Homo sapiens
FRVVCWPPRGCRPPRPVLGVPSLHPVCSPGSALLLSPWLRALVLTPRARVRLRVLYERASPPMGRPLLSPKPWVVRFSCRPPLGGGIL

SEQ ID NO: 753242 - protein, 655 aa, Homo sapiens; identical to SEQ ID NO: 753237

SEQ ID NO: 753243 - protein, 655 aa, Homo sapiens; identical to SEQ ID NO: 753237

SEQ ID NO: 753244 - protein, 684 aa, Homo sapiens
MVLYTTPFPNSCLSALHCVSWALIFPCYWLVDRLAASFIPTTYEKRQRADDPCCLQLLCTALFTPIYLALLVASLPFAFLGFLFWSPLQSARRPYIYSRLEDKGLAGGAALLSEWKGTGPGKSFCFATANVCLLPDSLARVNNLFNTQARAKEIGQRIRNGAARPQIKIYIDSPTNTSISAASFSSLVSPQGGDGVARAVPGSIKRTASVEYKGDGGRHPGDEAANGPASGDPVDSSSPEDACIVRIGGEEGGRPPEADDPVPGGQARNGAGGGPRGQTPNHNQQDGDSGSLGSPSASRESLVKGRAGPDTSASGEPGANSKLLYKASVVKKAAARRRRHPDEAFDHEVSAFFPANLDFLCLQEVFDKRAATKLKEQLHGYFEYILYDVGVYGCQGCCSFKCLNSGLLFASRYPIMDVAYHCYPNKCNDDALASKGALFLKVQVGSTPQDQRIVGYIACTHLHAPQEDSAIRCGQLDLLQDWLADFRKSTSSSSAANPEELVAFDVVCGDFNFDNCSSDDKLEQQHSLFTHYRDPCRLGPGEEKPWAIGTLLDTNGLYDEDVCTPDNLQKVLESEEGRREYLAFPTSKSSGQKGRKELLKGNGRRIDYMLHAEEGLCPDWKAEVEEFSFITQLSGLTDHLPVAMRLMVSSGEEEYERCIVVYDIILMFIIKILGFLYFIVCYVD

SEQ ID NO: 753245 - protein, 135 aa, Homo sapiens
LSMLASSKTVYTLFIIPQMLSSFVTQTQPISLAGCTTQTFFFVTLAINNCFLLTVMGYDHYMAICNPLRYRVITSKKVCVQLVCGAFSIGLAMAAVQVTSIFTLPFCHTVVGHFFCDILPVMKLSCINTTINEII

SEQ ID NO: 753246 - protein, 58 aa, Homo sapiens
MDCLLPGETPASSGSQILCRLRCWRQSRGKRGMRVFPKSPDTLPGPLSHPHTVPTIPT

SEQ ID NO: 753247 - protein, 660 aa, Homo sapiens
MGLQTTKWPSHGAFFLKSWLIISLGLYSQVSKLLACPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVFDNLSNLKQLTARNNPWFCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 753248 - protein, 642 aa, Homo sapiens
MGLQTTKWPSHGAFFLKSWLIISLGLYSQVSKLLACPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 753249 - protein, 73 aa, Homo sapiens
NPDDKDETTFIFIQKDFFLLKFQYQINTFQTLISKSISPTVVNSGQRNTDLQKIQYLNLAEHLASLVLPERRT

SEQ ID NO: 753250 - protein, 128 aa, Homo sapiens
MEMKSYQKINHFPGMSEICRKDLLARNMSRMLKMFPKDFRFFPRTWCLPADWGDLQTYSRSRKNKTYICKPDSGCQGKGIFITRTVKEIKPGEDMICQLYISKPFIIDGFKFDLRIYVLVTSCDPLRI

SEQ ID NO: 753251 - protein, 132 aa, Homo sapiens
TQRSSRCCTMSVSVLSPSRLLGDVSGILQAASLLILLLLLIKAVQLYLHRQWLLKALQQFPCPPSHWLFGHIQELQQDQELQRIQKWVETFPSACPPLAYGEAKFVSSSMTLPACLPVSYPPVSLVGSTLEG

SEQ ID NO: 753252 - protein, 367 aa, Homo sapiens
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVITWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGYDQLN

SEQ ID NO: 753253 - protein, 367 aa, Homo sapiens; identical to SEQ ID NO: 753252

SEQ ID NO: 753254 - protein, 367 aa, Homo sapiens; identical to SEQ ID NO: 753252

SEQ ID NO: 753255 - protein, 367 aa, Homo sapiens; identical to SEQ ID NO: 753252

SEQ ID NO: 753256 - protein, 367 aa, Homo sapiens; identical to SEQ ID NO: 753252

SEQ ID NO: 753257 - protein, 400 aa, Homo sapiens
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVITWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGLQAARTGSGSRLRQDWAPSLQPKALPQTTSVSASSLKG

SEQ ID NO: 753258 - protein, 220 aa, Homo sapiens
MNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVITWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGYDQLN

SEQ ID NO: 753259 - protein, 116 aa, Homo sapiens [sequence omitted]

SEQ ID NO: 753260 - protein, 367 aa, Homo sapiens
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVITWLQFLFCFSYIKLAVTLVKYFPQAYMNFYYKSTEGWSIGNVLLDFTGGSFSLLQMFLQSYNNDQWTLIFGDPTKFGLGVFSIVLSVHNSASVTAVTASPTQSISEP

SEQ ID NO: 753261 - protein, 112 aa, Homo sapiens
PHSRAQRKTDPRLSRSCTHRAQGLLAARTTALQRSPLQQEIWESTTALNLPSALAPQGLTAKDAHFLGDTDPIQEGARDHAAGGPFQDRQASVAAQTLSWERGQENTPLVEI

SEQ ID NO: 753262 - protein, 141 aa, Homo sapiens
MAEKPHQNSCNSVRQLFKTKQLVTHRDRGAQGLLAARTTALQRSPLQQEIWESTTALVFQAGNSLNAHSLRLSCMELNLPSALAPQGLTAKDAHFLGDTDPIQEGARDHAAGGPFQDRQASVAAQTLSWERGQENTPLVEI

SEQ ID NO: 753263 - protein, 104 aa, Homo sapiens
GSRISKYQLSQLSYSSTFDLPHSHLTLLYQISPQGLQEFSFISCCCSNQGKNLKPRMRFARGSKIWPRLSRHFLKSTTTPHTPGAINYEIQNQGKARPCISLLP

SEQ ID NO: 753264 - protein, 347 aa, Homo sapiens
MPRREVCWEAAHFRQEEQSLPRPRVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 753265 - protein, 331 aa, Homo sapiens
MGRRRPAPFRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 753266 - protein, 375 aa, Homo sapiens
GRAGPRRRWRRRRNRADGRAAAAPQTRVGRTAPAARGPAHRSPSGSRARPRAVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 753267 - protein, 375 aa, Homo sapiens; identical to SEQ ID NO: 753266

SEQ ID NO: 753268 - protein, 359 aa, Homo sapiens
QPREATQLPGGPGTSCLPSTQSGADLPWSFSGATSKVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 753269 - protein, 313 aa, Homo sapiens
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 753270 - protein, 337 aa, Homo sapiens
GCACAPRSVWWRCWVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 753271 - protein, 313 aa, Homo sapiens; identical to SEQ ID NO: 753269

SEQ ID NO: 753272 - protein, 375 aa, Homo sapiens; identical to SEQ ID NO: 753266

SEQ ID NO: 753273 - protein, 73 aa, Homo sapiens
GARARAGGGGGGGTELTGVRPLRRKLVWDAPLQPPAGQRTGPPAAAEPARAPVSRLGLGPGRWGPAARRRAGA

SEQ ID NO: 753274 - protein, 375 aa, Homo sapiens; identical to SEQ ID NO: 753266

SEQ ID NO: 753275 - protein, 375 aa, Homo sapiens; identical to SEQ ID NO: 753266

SEQ ID NO: 753276 - protein, 375 aa, Homo sapiens; identical to SEQ ID NO: 753266

SEQ ID NO: 753277 - protein, 331 aa, Homo sapiens; identical to SEQ ID NO: 753265

SEQ ID NO: 753278 - protein, 66 aa, Homo sapiens
GVGASVLAVWSLYFLFWTWFIEDLSFLPSCWRYIIGKWQGSEDDIRLSSQNDAIAPCIIRRDLRRE

SEQ ID NO: 753279 - protein, 317 aa, Homo sapiens
MWLYLAAFVGLYYLLHWYRERQVVSHLQDKYVFITGCDSGFGNLLARQLDARGLRVLAACLTEKGAEQLRGQTSDRLETVTLDVTKMESIAAATQWVKEHVGDRGLWGLVNNAGILTPITLCEWLNTEDSMNMLKVNLIGVIQVTLSMLPLVRRARGRIVNVSSILGRVAFFVGGYCVSKYGVEAFSDILRREIQHFGVKISIVEPGYFRTGMTNMTQSLERMKQSWKEAPKHIKETYGQQYFDALYNIMKEGLLNCSTNLNLVTDCMEHALTSVHPRTRYSAGWDAKFFFIPLSYLPTSLADYILTRSWPKPAQAV

SEQ ID NO: 753280 - protein, 317 aa, Homo sapiens; identical to SEQ ID NO: 753279

SEQ ID NO: 753281 - protein, 288 aa, Homo sapiens
MWLYLAAFVGLYYLLHWYRERQVVSHLQDKYVFITGCDSGFGNLLARQLDARGLRVLAACLTEKGAEQLRGQTSDRLETVTLDVTKMESIAAATQWVKEHVGDRGLWGLVNNAGILTPITLCEWLNTEDSMNMLKVNLIGVIQVTLSMLPLVRRARGRIVNVSSILGRVAFFVGGYCVSKYGVEAFSDILRREIQHFGVKISIVEPGYFRTGMTNMTQSLERMKQSWKEAPKHIKETYGQQYFDALYNIMKEGLLNCSTNLNLVFKNTGKSRTIGEYRELDIPADGEW

SEQ ID NO: 753282 - protein, 108 aa, Homo sapiens
MWLYLAAFVGLYYLLHWYRERQVVSHLQDKYVFITGCDSGFGNLLARQLDARGLRVLAACLTEKGAEQLRGQTSDRLETVTLDVTKMESIAAATQWVKEHVGDRGHSP

SEQ ID NO: 753283 - protein, 145 aa, Homo sapiens
IGSSKLGKIKMNGMLVVISREIQHFGVKISIVEPGYFRTGMTNMTQSLERMKQSWKEAPKHIKETYGQQYFDALYNIMKEGLLNCSTNLNLVTDCMEHALTSVHPRTRYSAGWDAKFFFIPLSYLPTSLADYILTRSWPKPAQAV

SEQ ID NO: 753284 - protein, 105 aa, Homo sapiens
MTNMTQSLERMKQSWKEAPKHIKETYGQQYFDALYNIMKEGLLNCSTNLNLVTDCMEHALTSVHPRTRYSAGWDAKFFFIPLSYLPTSLADYILTRSWPKPAQAV

SEQ ID NO: 753285 - protein, 259 aa, Homo sapiens
MWLYLAAFVGLYYLLHWYRERQVVSHLQDKYVFITGCDSGFGNLLARQLDARGLRVLAACLTEKGAEQLRGQTSDRLETVTLDVTKMESIAAATQWVKEHVGDRGLWGLVNNAGILTPITLCEWLNTEDSMNMLKVNLIGVIQVTLSMLPLVRRARGRIVNVSSILGRVAFFVGGYCVSKYGVEAFSDILRREIQHFGVKISIVEPGYFRTGMTNMTQSLERMKQSWKEAPKHIKETYGQQYFDARDRSFVGVGFVNFL

SEQ ID NO: 753286 - protein, 217 aa, Homo sapiens
MWLYLAAFVGLYYLLHWYRERQVVSHLQDKYVFITGCDSGFGNLLARQLDARGLRVLAACLTEKGAEQLRGQTSDRLETVTLDVTKMESIAAATQWVKEHVGDRGLWGLVNNAGILTPITLCEWLNTEDSMNMLKVNLIGVIQVTLSMLPLVRRARGRIVNVSSILGRVAFFVGGYCVSKYGVEAFSDILRREIQHFGVDTVLRANEAKLERSPQAY

SEQ ID NO: 753287 - protein, 137 aa, Homo sapiens
RAEFGTRDILRREIQHFGVKISIVEPGYFRTGMTNMTQSLERMKQSWKEAPKHIKETYGQQYFDALYNIMKEGLLNCSTNLNLVTDCMEHALTSVHPRTRYSAGWDAKFFFIPLSYLPTSLADYILTRSWPKPAQAV

SEQ ID NO: 753288 - protein, 187 aa, Homo sapiens
NTVLSGVTTMYPGIPNRMQKEITALAPSTMKIKIIAPPERKYSVWIGGSILASLSTFQQMWISKQEYDESGPSIVHRKCFYTDSGGVHTTESYDYSYGNTLTCGSPEGVGGPPEEAWAQLGELLFSASATHFYDDSRGNMQNRLRLTTQGPGHNLNHTGRSTPCTCPGTCSSRPDLTLPSELPQQRD

SEQ ID NO: 753289 - protein, 80 aa, Homo sapiens
NTVLSGVTTMYPGIPNRMQKEITALAPSTMKIKIIAPPERKYSVWIGGSILASLSTFQQMWISKQEYDESGPSIVHRKCF

SEQ ID NO: 753290 - protein, 101 aa, Homo sapiens
LEELFAAVPKVAHLAHSPLRLWSPPGKALIPCRYFSGECGFHPGLGASLLTHSAPRILVPCPLAQLLPARKQVFGLPEKPCPSCCLLPVPPVPSGTERDFV

SEQ ID NO: 753291 - protein, 96 aa, Homo sapiens
PQPRVAAMNPEYDYLFKLLLIGDSGVGKSCLLLRFADDTYTESYISTIGVDFKIRTIELDGKTIKLQIWDTAGQERFRTITSSYYRGCVPWGGDPQ

SEQ ID NO: 753292 - protein, 250 aa, Homo sapiens
PGISAARPEKKTFAPARRGRGLWGGAATILEREAEQSRLGATERAAAAAMNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 753293 - protein, 201 aa, Homo sapiens
MNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 753294 - protein, 232 aa, Homo sapiens
SKRPNTSNKRRKKNAMIAGVLWDDERAARVRMNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 753295 - protein, 201 aa, Homo sapiens; identical to SEQ ID NO: 753293

SEQ ID NO: 753296 - protein, 250 aa, Homo sapiens; identical to SEQ ID NO: 753292

SEQ ID NO: 753297 - protein, 250 aa, Homo sapiens; identical to SEQ ID NO: 753292

SEQ ID NO: 753298 - protein, 134 aa, Homo sapiens
SEVIYEDPELSLLGLMLIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 753299 - protein, 169 aa, Homo sapiens
MNPEYDYLFKLLLIGDSGVGKSCLLLRFADDTYTESYISTIGVDFKIRTIELDGKTIKLQIESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 753300 - protein, 286 aa, Homo sapiens
PGISAARPEKKTFAPARRGRGLWGGAATILEREAEQSRLGATERAAAAAMNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKVADGPVCPGSGRWGLLPLTCSPLLFSPLLFSPLPCQEFADSLGIPFLETSAKNATNVEQAFMTMAAEIKKRMGPGAASGGERPNLKIDSTPVKPAGGGCC

SEQ ID NO: 753301 - protein, 173 aa, Homo sapiens [sequence omitted]

SEQ ID NO: 753302 - protein, 173 aa, Homo sapiens [sequence omitted]

SEQ ID NO: 753303 - protein, 148 aa, Homo sapiens
PGISAARPEKKTFAPARRGRGLWGGAATILEREAEQSRLGATERAAAAAMNPEYDYLFKLLLIGDSGVGKSCLLLRFADDTYTESYISTIGVDFKIRTIELDGKTIKLQIWDTAGQERFRTITSSYYRGVALGCPGLPISFWPICLLP

SEQ ID NO: 753304 - protein, 138 aa, Homo sapiens
PGISAARPEKKTFAPARRGRGLWGGAATILEREAEQSRLGATERAAAAAMNPEYDYLFKLLLIGDSGVGKSCLLLRFADDTYTESYISTIGVDFKIRTIELDGKTIKLQIWDTAGQERFRTITSSYYRGPAAVGSEYI

SEQ ID NO: 753305 - protein, 250 aa, Homo sapiens; identical to SEQ ID NO: 753292

SEQ ID NO: 753306 - protein, 98 aa, Homo sapiens
GGADGPEALNGPEALNGPEALNGPEALMAPQGSTSGSLPTPSLEPTREGPHPLPLLLWGMWVPSRIGGLSAHPLCTQDPSPLPSGTAASCKKASLWSP

SEQ ID NO: 753307 - protein, 295 aa, Homo sapiens
PGISAARPEKKTFAPARRGRGLWGGAATILEREAEQSRLGATERAAAAAMNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVPSSLYLSPWAAPLGCPPLPGSPLVSCQAFCKEKPLGERWKRTKKINKFPLALG

SEQ ID NO: 753308 - protein, 146 aa, Homo sapiens
PGISAARPEKKTFAPARRGRGLWGGAATILEREAEQSRLGATERAAAAAMNPEYDYLFKLLLIGDSGVGKSCLLLRFADDTYTESYISTIGVDFKIRTIELDGKTIKLQIWDTAGQERFRTITSSYYRGAHGIIVVYDVTDQVLLD

SEQ ID NO: 753309 - protein, 173 aa, Homo sapiens
PTRSPTRRWHHFVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVPSSLYLSPWAAPLGCPPLPGSPLVSCQAFCKEKPLGERWKRTKKINKFPLALG

SEQ ID NO: 753310 - protein, 134 aa, Homo sapiens; identical to SEQ ID NO: 753298

SEQ ID NO: 753311 - protein, 140 aa, Homo sapiens
MWLGPASVSGRETAAGSRAGRPKLGQLLRCWGSWQAAGAVLGLGWKRAGRKVQPGAEGFLCISASLSPGLKGPGAVLFPSEKVFSRPGVGVTVGSKITLAPGPLEESYANVKQWLQEIDRYASENVNKLLVGSLYGGSSG

SEQ ID NO: 753312 - protein, 250 aa, Homo sapiens; identical to SEQ ID NO: 753292

SEQ ID NO: 753313 - protein, 250 aa, Homo sapiens; identical to SEQ ID NO: 753292

SEQ ID NO: 753314 - protein, 220 aa, Homo sapiens
SVPRMWEAGALGATRGAIAHERGSDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 753315 - protein, 116 aa, Homo sapiens
GYRRPRRRESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 753316 - protein, 127 aa, Homo sapiens
FEDHAHGLSDPRGYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 753317 - protein, 213 aa, Homo sapiens
MWLGPASVSGRETAAGSRAGRPKLGQLLRCWGSWQAAGAVLGLGWKRAGRKVQPGAEGFLCISASLSPGLKGPGAVLFPSEKVFSRPGVGVTVGSKITLAPGPLEESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 753318 - protein, 250 aa, Homo sapiens; identical to SEQ ID NO: 753292

SEQ ID NO: 753319 - protein, 250 aa, Homo sapiens; identical to SEQ ID NO: 753292

SEQ ID NO: 753320 - protein, 250 aa, Homo sapiens; identical to SEQ ID NO: 753292

SEQ ID NO: 753321 - protein, 108 aa, Homo sapiens
MRCLPTVPLCPHVRRRRKAHRARGWAPALTLTLLAPPPFPQGSTSGSLPTPSLEPTREGPHPLPLLLWGMWVPSRIGGLSAHPLCTQDPSPLPSGTAASCKKASLWSP

SEQ ID NO: 753322 - protein, 252 aa, Homo sapiens
PGISAARPEKKTFAPARRGRGLWGGAATILEREAEQSRLGATERAAAAAMNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPATPSRAKTHYT

SEQ ID NO: 753323 - protein, 220 aa, Homo sapiens
PGISAARPEKKTFAPARRGRGLWGGAATILEREAEQSRLGATERAAAAAMNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFAAGESPEPERQRRQRAQDHSHCTQPGLQGPLD

SEQ ID NO: 753324 - protein, 967 aa, Homo sapiens
MKKPSTEGGEEHVFENSPVLDERSALYSGVHKKPLFFDGSPEKPPEDDSDSLTTSPSSSSLDTWGAGRKLVKTFSKGESRGLIKPPKKMGTFFSYPEEEKAQKVSRSLTEGEMKKGLGSLSHGRTCSFGGFDLTNRSLHVGSNNSDPMGKEGDFVYKEVIKSPTASRISLGKKVKSVKETMRKRMSKKYSSSVSEQDSGLDGMPGSPPPSQPDPEHLDKPKLKAGGSVESLRSSLSGQSSMSGQTVSTTDSSTSNRESVKSEDGDDEEPPYRGPFCGRARVHTDFTPSPYDTDSLKLKKGDIIDIISKPPMGTWMGLLNNKVGTFKFIYVDVLSEDEEKPKRPTRRRRKGRPPQPKSVEDLLDRINLKEHMPTFLFNGYEDLDTFKLLEEEDLDELNIRDPEHRAVLLTAVELLQEYDSNSDQSGSQEKLLVDSQGLSGCSPRDSGCYESSENLENGKTRKASLLSAKSSTEPSLKSFSRNQLGNYPTLPLMKSGDALKQGQEEGRLGGGLAPDTSKSCDPPGVTGLNKNRRSLPVSICRSCETLEGPQTVDTWPRSHSLDDLQVEPGAEQDVPTEVTEPPPQIVPEVPQKTTASSTKAQPLERDSAVDNALLLTQSKRFSEPQKLTTKKLEGSIAASGRGLSPPQCLPRNYDAQPPGAKHGLARTPLEGHRKGHEFEGTHHPLGTKEGVDAEQRMQPKIPSQPPPVPAKKSRERLANGLHPVPMGPSGALPSPDAPCLPVKRGSPASPTSPSDCPPALAPRPLSGQAPGSPPSTRPPPWLSELPENTSLQEHGVKLGPALTRKVSCARGVDLETLTENKLHAEGIDLTEEPYSDKHGRCGIPEALVQRYAEDLDQPERDVAANMDQIRVKQLRKQHRMAIPSGGLTEICRKPVSPGCISSVSDWLISIGLPMYAGTLSTAGFSTLSQVPSLSHTCLQEAGITEERHIRKLLSAARLFKLPPGPEAM

SEQ ID NO: 753325 - protein, 199 aa, Homo sapiens
MEDAGAAGPGPEPEPEPEPEPEPAPEPEPEPKPGAGTSEAFSRLWTDVMGILDGSLGNIDDLAQQYADYYNTCFSDVCERMEELRKRRVSQDLEVEKPDASPTSLQLRSQIEESLGFCSAVSTPEVERKNPLHKSNSEDSSVGQYHFSWFTYLIISILYRKHEYVKIQNPQESFYSEINTVKILMYILILLFLGSFKKI

SEQ ID NO: 753326 - protein, 1247 aa, Homo sapiens
MEDAGAAGPGPEPEPEPEPEPEPAPEPEPEPKPGAGTSEAFSRLWTDVMGILDGSLGNIDDLAQQYADYYNTCFSDVCERMEELRKRRVSQDLEVEKPDASPTSLQLRSQIEESLGFCSAVSTPEVERKNPLHKSNSEDSSVGKGDWKKKNKYFWQNFRKNQKGIMRQTSKGEDVGYVASEITMSDEERIQLMMMVKEKMITIEEALARLKEYEAQHRQSAALDPADWPDGSYPTFDGSSNCNSREQSDDETEESVKFKRLHKLVNSTRRVRKKLIRVEEMKKPSTEGGEEHVFENSPVLDERSALYSGVHKKPLFFDGSPEKPPEDDSDSLTTSPSSSSLDTWGAGRKLVKTFSKGESRGLIKPPKKMGTFFSYPEEEKAQKVSRSLTEGEMKKGLGSLSHGRTCSFGGFDLTNRSLHVGSNNSDPMGKEGDFVYKEVIKSPTASRISLGKKVKSVKETMRKRMSKKYSSSVSEQDSGLDGMPGSPPPSQPDPEHLDKPKLKAGGSVESLRSSLSGQSSMSGQTVSTTDSSTSNRESVKSEDGDDEEPPYRGPFCGRARVHTDFTPSPYDTDSLKLKKGDIIDIISKPPMGTWMGLLNNKVGTFKFIYVDVLSEDEEKPKRPTRRRRKGRPPQPKSVEDLLDRINLKEHMPTFLFNGYEDLDTFKLLEEEDLDELNIRDPEHRAVLLTAVELLQEYDSNSDQSGSQEKLLVDSQGLSGCSPRDSGCYESSENLENGKTRKASLLSAKSSTEPSLKSFSRNQLGNYPTLPLMKSGDALKQGQEEGRLGGGLAPDTSKSCDPPGVTGLNKNRRSLPVSICRSCETLEGPQTVDTWPRSHSLDDLQVEPGAEQDVPTEVTEPPPQIVPEVPQKTTASSTKAQPLERDSAVDNALLLTQSKRFSEPQKLTTKKLEGSIAASGRGLSPPQCLPRNYDAQPPGAKHGLARTPLEGHRKGHEFEGTHHPLGTKEGVDAEQRMQPKIPSQPPPVPAKKSRERLANGLHPVPMGPSGALPSPDAPCLPVKRGSPASPTSPSDCPPALAPRPLSGQAPGSPPSTRPPPWLSELPENTSLQEHGVKLGPALTRKVSCARGVDLETLTENKLHAEGIDLTEEPYSDKHGRCGIPEALVQRYAEDLDQPERDVAANMDQIRVKQLRKQHRMAIPSGGLTEICRKPVSPGCISSVSDWLISIGLPMYAGTLSTAGFSTLSQVPSLSHTCLQEAGITEERHIRKLLSAARLFKLPPGPEAM

SEQ ID NO: 753327 - protein, 967 aa, Homo sapiens; identical to SEQ ID NO: 753324

SEQ ID NO: 753328 - protein, 65 aa, Homo sapiens
EIWIYPCSSYVSCTGGQTVSTTDSSTSNRESVKSEDGDDEEPPYRGPFCGRARVHTDFTPSPYDT

SEQ ID NO: 753329 - protein, 101 aa, Homo sapiens
HRNPVIETLNPYTSRPLRQLTRLFGGPSYIACSNLRVCCHRNPSSKPSLIVNFGISHERQDAHWVFCRVRNAAYSLPERLTQGCVLRSPGGNGPSFPTEQY

SEQ ID NO: 753330 - protein, 56 aa, Homo sapiens
MVARQPQAPGDTSPLPALYCLPAALLGVLYEDKERQDFIFTIYHWWQAVAIFTVYL

SEQ ID NO: 753331 - protein, 72 aa, Homo sapiens
RRRPEAHRRPQAQTPLPSCERTAGQTPKLARQASIELPSMAASSTKSWWETGEVQAQSAAKTPSCKMDSVTT

SEQ ID NO: 753332 - protein, 80 aa, Homo sapiens
TPSIHPQCYLLIEVLDAFCLHGCQSLWAGLCVDVFTPTPISSIQRSTTKAILLKHNHSVLHTPYDSLPPTLLIINPINKN

SEQ ID NO: 753333 - protein, 98 aa, Homo sapiens
RRRPEAHRRPQAQTPLPSCERTAGQTPKLARQASIELPSMAASSTKSWWETGEVQAQSAAKTPSCKDIVAGDMSKKSLWEQKGGSKTSSTIKMDSVTT

SEQ ID NO: 753334 - protein, 83 aa, Homo sapiens
RRRPEAHRRPQAQTPLPSCERTAGQTPKLARQASIELPSMAASSTKSWWETGEVQAQSAAKTPSCKTLWQLHWVLAEFWKTGM

SEQ ID NO: 753335 - protein, 91 aa, Homo sapiens
NNEHNRSKSAGDGKKVSIPAGTSNASRPRPTRLTVHKTELLHNNATTTATHQKKHPPKGAWFAPTPSNTGNKQINTRGMASRLNSALTRRN

SEQ ID NO: 753336 - protein, 113 aa, Homo sapiens
QADLELLSSSDPPVLASQSAGITGASHCNWPIKFLTPYLTDQLTLPRPVIWLNQSCDPTQEQKTARKPHFNTPVDDSIDLRKLQPISTPHFLSPYPPNYLSKLGSPNAQRRLI

SEQ ID NO: 753337 - protein, 297 aa, Homo sapiens
MKHIINSYENINNTARNNSDCPRVVLPEEIFFTISIVGVLENLIVLLAVFKNKNLQAPMYFFICSLAISDMLGSLYKILENILIILRNMGYLKPRGSFETTADDIIDSLFVLSLLGSIFSLSVIAADRYITIFHALRYHSIVTMRRTVVVLTVIWTFCTGTGITMVIFSHHVPTVITFTSLFPLMLVFILCLYVHMFLLARSHTRKISTLPRANMKGAITLTILLGVFIFCWAPFVLHVLLMTFCPSNPYCACYMSLFQVNGMLIMCNAVIDPFIYAFRSPELRDAFKKMIFCSRYW

SEQ ID NO: 753338 - protein, 170 aa, Homo sapiens [sequence omitted]

SEQ ID NO: 753339 - protein, 107 aa, Homo sapiens
SHLLFTGRQYSEYRMDTIPVTIATDLATVTLVLLIAKYKGLCSDFLLLAFSAGLPPSFVKPSFAMTDLSLPFGSLTSAGPLNAVVLKALSLVSWVHLGPIHFQVLHY

SEQ ID NO: 753340 - protein, 67 aa, Homo sapiens
AVVNDTSGENKSGAADIAASQHVMVCALQELGSLVQSLNATASPLIQEASIGLLEIVTSVLLHPSMA

SEQ ID NO: 753341 - protein, 67 aa, Homo sapiens
GFAIYASDSFFVGICNRIQFCHRSSAMSMIGSSSNEPRYRTSWYAPENRSVFPGSATGCNKLAAAST

SEQ ID NO: 753342 - protein, 69 aa, Homo sapiens
PSAFRNLQVLASTFMGASKLPAHKPGSSRAFPGSPCSALLRGHPQSQSTSKSPPSFGEEVTSPCEHHID

SEQ ID NO: 753343 - protein, 542 aa, Homo sapiens
MAKGFYISKSLGILGILLGVAAVCTIIALSVVYSQEKNKNANSSPVASTTPSASATTNPASATTLDQSKAWNRYRLPNTLKPDSYQVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNR

SEQ ID NO: 753344 - protein, 967 aa, Homo sapiens
MAKGFYISKSLGILGILLGVAAVCTIIALSVVYSQEKNKNANSSPVASTTPSASATTNPASATTLDQSKAWNRYRLPNTLKPDSYQVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 753345 - protein, 159 aa, Homo sapiens
MFIFNSIADDIFPLISCVGAIHCNILAIRTGNDFAAIKLQVIKLIYLMIWHSLVIISPVVTLAFFPASLKQGSLHFLLIIYFVLLLTPWLEFSKSGTHLPSNTKIIPAWWVSMDAYLNHASICCHQFSCLSAVKLQLSNEELIRDTRWDIQSYTTDFSF

SEQ ID NO: 753346 - protein, 156 aa, Homo sapiens
MKKQGVSPKPLQSSRPSPSKRPCGASPAREREVEKSALGGGKLPGGARRSSPGRIPNLKKRKGLELKVVAKALLGPFQFVCNSLAQLREEVHELQARWFPSRTTLHRGIENKEFPNQTGAQAVFAAPVKAPYPEPCLPAPSRLCGNSTLVTFSNTF

SEQ ID NO: 753347 - protein, 102 aa, Homo sapiens
GCGGLCVGLPSPEAARSGKRGGGGAARAGEHVGGHAGTARANGFQRMRPTLHFTVAMTTRRSASQRLVNGCGDKSVEAARRVRPFWTSPDSAGLCLKLTQLH

SEQ ID NO: 753348 - protein, 102 aa, Homo sapiens; identical to SEQ ID NO: 753347

SEQ ID NO: 753349 - protein, 141 aa, Homo sapiens
MKKQGVSPKPLQSSRPSPSKRPCGASPAREREVEKSALGGGKLPGGARRSSPGRIPNLKKRKGLELKVVAKALLGPFQFVCNSLAQLREEVHELQARWFPSRTTLHRGIENKEFPNQTGAQAVFAAPVKAPYPEPCLPAPR

SEQ ID NO: 753350 - protein, 122 aa, Homo sapiens
MKKQGVSPKPLQSSRPSPSKRPCGASPAREREVEKSALGGGKLPGGARRSSPGRIPNLKKRKGLELKVVAKALLGPFQFVCNSLAQLREEVHELQARWFPSRTTLHRRLCGNSTLVTFSNTF

SEQ ID NO: 753351 - protein, 102 aa, Homo sapiens; identical to SEQ ID NO: 753347

SEQ ID NO: 753352 - protein, 102 aa, Homo sapiens; identical to SEQ ID NO: 753347

SEQ ID NO: 753353 - protein, 303 aa, Homo sapiens
MFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 753354 - protein, 303 aa, Homo sapiens; identical to SEQ ID NO: 753353

SEQ ID NO: 753355 - protein, 303 aa, Homo sapiens; identical to SEQ ID NO: 753353

SEQ ID NO: 753356 - protein, 216 aa, Homo sapiens
MKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 753357 - protein, 315 aa, Homo sapiens
MFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRIPVTCHRDSFSRMSLRKMDL

SEQ ID NO: 753358 - protein, 517 aa, Homo sapiens
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVEKGMAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSSLHPVLLPSDVFDQPQPVGNKRIEFHISTDMPAAFKKDLEKEQNCEEKNHDLPATEVDASNIGFGKIFPKPNLDITEEIKEDSDEMPSECISRRELEKGRISREEMETLSVFRSYEPGEPNCRIYVKNLAKHVQEKDLKYIFGRYVDFSSETQRIMFDIRLMKEGRMKGQAFIGLPNEKAAAKALKEANGYVLFGKPMVVQFARSARPKQDPKEGKRKC

SEQ ID NO: 753359 - protein, 70 aa, Homo sapiens
LGPHVLGSIKSEPCNTNVNEMIHIFGNLGTHIIFLQCKIKKTNQTTISDLLRFLWIPMSFKCFATLRRRN

SEQ ID NO: 753360 - protein, 517 aa, Homo sapiens; identical to SEQ ID NO: 753358

SEQ ID NO: 753361 - protein, 517 aa, Homo sapiens; identical to SEQ ID NO: 753358

SEQ ID NO: 753362 - protein, 517 aa, Homo sapiens; identical to SEQ ID NO: 753358

SEQ ID NO: 753363 - protein, 517 aa, Homo sapiens; identical to SEQ ID NO: 753358

SEQ ID NO: 753364 - protein, 517 aa, Homo sapiens; identical to SEQ ID NO: 753358

SEQ ID NO: 753365 - protein, 314 aa, Homo sapiens
MNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFVPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVIFRNVVDGQPFTNWYDNGSNQVAFGRGNRGFIVFNNDDWSFSLTLQTGLPAGTYCDVISGDKINGNCTGIKIYVSDDGKAHFSISNSAEDPFIAIHAESKL

SEQ ID NO: 753366 - protein, 517 aa, Homo sapiens; identical to SEQ ID NO: 753358

SEQ ID NO: 753367 - protein, 407 aa, Homo sapiens
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVEKGMAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSSLHPVLLPSDVFDQPQPVGNKRIEFHISTDMPAAFKKDLEKEQNCEEKNHDLPATEVDASNIGFGKIFPKPNLDITEEIKEDSDEMPSECISRRELEKGRISREGNVTK

SEQ ID NO: 753368 - protein, 517 aa, Homo sapiens; identical to SEQ ID NO: 753358

SEQ ID NO: 753369 - protein, 517 aa, Homo sapiens; identical to SEQ ID NO: 753358

SEQ ID NO: 753370 - protein, 517 aa, Homo sapiens; identical to SEQ ID NO: 753358

SEQ ID NO: 753371 - protein, 517 aa, Homo sapiens; identical to SEQ ID NO: 753358

SEQ ID NO: 753372 - protein, 517 aa, Homo sapiens; identical to SEQ ID NO: 753358

SEQ ID NO: 753373 - protein, 438 aa, Homo sapiens
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVEKGMAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSSLHPVLLPSDVFDQPQPVGNKRIEFHISTDMPAAFKKDLEKEQNCEEKNHDLPATEVDASNIGFGKIFPKPNLDITEEIKEDSDEMPSECISRRELEKGRISREEMETLSVFRSYEPGEPNCRIYVKNLAKHVQEKVGIN

SEQ ID NO: 753374 - protein, 213 aa, Homo sapiens
MNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIQEHG

SEQ ID NO: 753375 - protein, 517 aa, Homo sapiens; identical to SEQ ID NO: 753358

SEQ ID NO: 753376 - protein, 517 aa, Homo sapiens; identical to SEQ ID NO: 753358

SEQ ID NO: 753377 - protein, 517 aa, Homo sapiens; identical to SEQ ID NO: 753358

SEQ ID NO: 753378 - protein, 405 aa, Homo sapiens
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSLLGIISHACNPNNLEAEEGGPLKLRNLRLQWTVIASLHSSLGDIEETPTQQVRDCRLVGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIQEHG

SEQ ID NO: 753379 - protein, 175 aa, Homo sapiens [sequence omitted]

SEQ ID NO: 753380 - protein, 140 aa, Homo sapiens
SSPCCPGPRRHGLKRGCSHSQEKGRLEEALGEPQALSREMGSFAFRLASPPSPSPVPASLPQTHSASHAGAHAGWPRGLSQQQGLWFTPVLIIAQFQKHPTLRKDLAGGILRRVCGDVEGLLCGQLSLWWSLARIPFGLQ

SEQ ID NO: 753381 - protein, 115 aa, Homo sapiens
MGVPPYQALDFDVLKKCSRGWKTHFDSVLTVEHSLVGFQTPRFSGTVRGAEMSITVVQSARSQTGPHTGGFVKSFVLWLWTVSWNGFWSQVILFYPQDLGHGHLKLYRTGTPGFL

SEQ ID NO: 753382 - protein, 282 aa, Homo sapiens
VSLELSVHSAEEIEGKVQGMNVSKLRNTRVNVDFQKQTVDPMQVSFNTSDRSQTVTDLLLTIDVTEVVEVGHFWGYRIDENNSEILKKLTAEINQLTLVPLPTHPHPDLVCLAPFADFDKQRYFRAQVLYVSGNSAEVFFVDYGNKSHVDLHLLMEIPCQFLELPFQALEFKICKMRPSAKSLVCGKHWSDGASQWFASLVSGCTLLVKVFSVVHSVLHVDVYQYSGVQDAINIRDVLIQQGYAELTGGVLRSPRQSHGSFFKGPLFPSSVEENTVGSVAFS

SEQ ID NO: 753383 - protein, 106 aa, Homo sapiens
MLRIVEPYVTWGFPNLKSVRELILKRGQAKVKNKTIPLTDNTVIEEHLGKFGVICLEDLIHEIAFPGKHFQEISWFLCPFHLSVARHATKNKSGLPQGDGHTWLSG

SEQ ID NO: 753384 - protein, 226 aa, Homo sapiens
PFGSRKSPEKEEGLSSPQSHPGKAGTYGRARQKKGKGLRFKRLESFLHDSWRQKRDKVRLRRLEVKPHALELPDKHSLAFVVRIERIDGVSLLVQRTIARLRLKKIFSGVFVKVTPQNLKMLRIVEPYVTWGFPNLKSVRELILKRGQAKVKNKTIPLTDNTVIEEHLGKFGVICLEDLIHEIAFPGKHFQEISWFLCPFHLSVARHATKNKSGLPQGDGHTWLSG

SEQ ID NO: 753385 - protein, 1076 aa, Homo sapiens
QGAWNGLDGPFGRKASRDRSGGTQDLSSQRGKGQRGGKRSLGEQGSLEAENGEVQGPGALKEDEGQGVEEAGRSGRRPGSLRSRSQAQSGAEVGGGKRRGADEAGSMGWQPMGENWGCLEEMLNEDQSREPPGHLGSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPVIVKIPFQSHLPIQAAWRKDGAEVVGSSDREAQVDLGDGYTRLCLPSAGRKDCGQYSVTLRSEGGSVQAELTLQVIGTSPVFPQLRPESPWGSGPSLPSRAGLGYDLCWLCSSFACCLRSRPTTNSAQTAEEEAVEMNTVLGSCWGGGAGYASLTPIHWALRKLLGRMVVPSPEWCQQDKPDPPQGPMEVQDCHRAGVCLRWRPPRDNGGRTVECYVVERRQAGRSTWLKVGEAPADSTTFTDAHVEPGRKYTFRVRAVTSEGAGEALESEEILVAPEALPKAPSAPAILSASSQGITLTWTAPRGPGSAHILGYLIERRKKGSNTWTAVNDQPVPERRWTVADVRQGCQYEFRVTAVAPSGPGEPGPPSDAVFARDPMRPPGLVRNLQVTDRSNTSITLSWAGPDTQEGDEAQGYVVELCSSDSLQWLPCHVGTVPVTTYTAKGLRPGEGYFVRVTAVNEGGQSQPSALDTLVQAMPVTVCPKFLVDSSTKDLLTVKVGDTVRVPVSFEAMPMPEVTWLKDGLPLPKRSVTVTKDGLTQLLIPVAGLSDSGLYTVVLEDLQGKEVAHSFRIRVAACPQAPGPIHLQENVPGTVTAEWEPSPDEAQDVPLHYAVFTRSSAHGPWHEAADRIYTNRFTLLGILPGHEYHFRVVAKNELGASKPSDTSQPWCIPRQRDRFTVKAPCYREPDLSQKPRFLVGLRSHLLPQGCECCMSCAVQGSPRPHVTWFKNDRSLEGNPAVYSTDLLGVCSLTIPSVSPKDSGEYKAVAENTLGQAVSTATLIVIEPST

SEQ ID NO: 753386 - protein, 1011 aa, Homo sapiens
QGAWNGLDGPFGRKASRDRSGGTQDLSSQRGKGQRGGKRSLGEQGSLEAENGEVQGPGALKEDEGQGVEEAGRSGRRPGSLRSRSQAQSGAEVGGGKRRGADEAGSMGWQPMGENWGCLEEMLNEDQSREPPGHLGSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPVIVKIPFQSHLPIQAAWRKDGAEVVGSSDREAQVDLGDGYTRLCLPSAGRKDCGQYSVTLRSEGGSVQAELTLQVIGTSPVFPQLRPESPWGSGPSLPSRAGLGYDLCWLCSSFACCLRSRPTTNSAQTAEEEAVEMNTVLGSCWGGGAGYASLTPIHWALRKLLGRMVVPSPEWCQQDKPDPPQGPMEVQDCHRAGVCLRWRPPRDNGGRTVECYVVERRQAGRSTWLKVGEAPADSTTFTDAHVEPGRKYTFRVRAVTSEGAGEALESEEILVAPEALPKAPSAPAILSASSQGITLTWTAPRGPGSAHILGYLIERRKKGSNTWTAVNDQPVPERRWTVADVRQGCQYEFRVTAVAPSGPGEPGPPSDAVFARDPMRPPGLVRNLQVTDRSNTSITLSWAGPDTQEGDEAQGYVVELCSSDSLQWLPCHVGTVPVTTYTAKGLRPGEGYFVRVTAVNEGGQSQPSALDTLVQAMPVTVCPKFLVDSSTKDLLTVKVGDTVRVPVSFEHALQAPGPIHLQENVPGTVTAEWEPSPDEAQDVPLHYAVFTRSSAHGPWHEAADRIYTNRFTLLGILPGHEYHFRVVAKNELGASKPSDTSQPWCIPRQRDRFTVKAPCYREPDLSQKPRFLVGLRSHLLPQGCECCMSCAVQGSPRPHVTWFKNDRSLEGNPAVYSTDLLGVCSLTIPSVSPKDSGEYKAVAENTLGQAVSTATLIVIEPST

SEQ ID NO: 753387 - protein, 1011 aa, Homo sapiens; identical to SEQ ID NO: 753386

SEQ ID NO: 753388 - protein, 730 aa, Homo sapiens
FVSLSPFFLFSAEVFNFDRAKSINLGLAPRQQRGRGGERGTGGGEGAGISRRSGCQSCWECARSDHKAAAEEAQPAAAVPPSFLLPSRSLFRPPAPSLPACVTAAAMAENGESSGPPRPSRGPAAAQGSAAAPAEPKIIKVTVKTPKEKEEFAVPENSSVQQFKEAISKRFKSQTDQLVLIFAGKILKDQDTLIQHGIHDGLTVHLVIKSQNRPQGQSTQPSNAAGTNTTSASTPRSNSTPISTNSNPFGLGSLGGLAGLSSLGLSSTNFSELQSQMQQQLMASPEMMIQIMENPFVQSMLSNPDLMRQLIMANPQMQQLIQRNPEISHLLNNPDIMRQTLEIARNPAMMQEMMRNQDLALSNLESIPGGYNALRRMYTDIQEPMLNAAQEQFGGNPFASVGSSSSSGEGTQPSRTENRDPLPNPWAPPPATQSSATTSTTTSTGSGSGNSSSNATGNTVAAANYVASIFSTPGMQSLLQQITENPQLIQNMLSAPYMRSMMQSLSQNPDLAAQMMLNSPLFTANPQLQEQMRPQLPAFLQQMQNPDTLSAMSNPRAMQALMQIQQGLQTLATEAPGLIPSFTPGVGVGVLGTAIGPVGPVTPIGPIGPIVPFTPIGPIGPIGPTGPAAPPGSTGSGGPTGPTVSSAAPSETTSPTSESGPNQQFIQQMVQALAGANAPQLPNPEVRFQQQLEQLNAMGFLNREANLQALIATGGDINAAIERLLGSQPS

SEQ ID NO: 753389 - protein, 624 aa, Homo sapiens
MAENGESSGPPRPSRGPAAAQGSAAAPAEPKIIKVTVKTPKEKEEFAVPENSSVQQFKEAISKRFKSQTDQLVLIFAGKILKDQDTLIQHGIHDGLTVHLVIKSQNRPQGQSTQPSNAAGTNTTSASTPRSNSTPISTNSNPFGLGSLGGLAGLSSLGLSSTNFSELQSQMQQQLMASPEMMIQIMENPFVQSMLSNPDLMRQLIMANPQMQQLIQRNPEISHLLNNPDIMRQTLEIARNPAMMQEMMRNQDLALSNLESIPGGYNALRRMYTDIQEPMLNAAQEQFGGNPFASVGSSSSSGEGTQPSRTENRDPLPNPWAPPPATQSSATTSTTTSTGSGSGNSSSNATGNTVAAANYVASIFSTPGMQSLLQQITENPQLIQNMLSAPYMRSMMQSLSQNPDLAAQMMLNSPLFTANPQLQEQMRPQLPAFLQQMQNPDTLSAMSNPRAMQALMQIQQGLQTLATEAPGLIPSFTPGVGVGVLGTAIGPVGPVTPIGPIGPIVPFTPIGPIGPIGPTGPAAPPGSTGSGGPTGPTVSSAAPSETTSPTSESGPNQQFIQQMVQALAGANAPQLPNPEVRFQQQLEQLNAMGFLNREANLQALIATGGDINAAIERLLGSQPS

SEQ ID NO: 753390 - protein, 551 aa, Homo sapiens
MAENGESSGPPRPSRGPAAAQGSAAAPAEPKIIKVTVKTPKEKEEFAVPENSSVQQFKEAISKRFKSQTDQLVLIFAGKILKDQDTLIQHGIHDGLTVHLVIKSQNRPQGQSTQPSNAAGTNTTSASTPRSNSTPISTNSNPFGLGSLGGLAGLSSLGLSSTNFSELQSQMQQQLMASPEMMIQIMENPFVQSMLSNPDLMRQLIMANPQMQQLIQRNPEISHLLNNPDIMRQTLEIARNPAMMQEMMRNQDLALSNLESIPGGYNALRRMYTDIQEPMLNAAQEQFGGNPFASVGSSSSSGEGTQPSRTENRDPLPNPWAPPPATQSSATTSTTTSTGSGSGNSSSNATGNTVAAANYVASIFSTPGMQSLLQQITENPQLIQNMLSAPYMRSMMQSLSQNPDLAAQMMLNSPLFTANPQLQEQMRPQLPAFLQQMQNPDTLSAMSNPRAMQALMQIQQGLQTLATEAPSETTSPTSESGPNQQFIQQMVQALAGANAPQLPNPEVRFQQQLEQLNAMGFLNREANLQALIATGGDINAAIERLLGSQPS

SEQ ID NO: 753391 - protein, 275 aa, Homo sapiens
LHAWGTKDAGDIISGSNGVPSSLLQQITENPQLIQNMLSAPYMRSMMQSLSQNPDLAAQMMLNSPLFTANPQLQEQMRPQLPAFLQQMQNPDTLSAMSNPRAMQALMQIQQGLQTLATEAPGLIPSFTPGVGVGVLGTAIGPVGPVTPIGPIGPIVPFTPIGPIGPIGPTGPAAPPGSTGSGGPTGPTVSSAAPSETTSPTSESGPNQQFIQQMVQALAGANAPQLPNPEVRFQQQLEQLNAMGFLNREANLQALIATGGDINAAIERLLGSQPS

SEQ ID NO: 753392 - protein, 624 aa, Homo sapiens; identical to SEQ ID NO: 753389

SEQ ID NO: 753393 - protein, 624 aa, Homo sapiens; identical to SEQ ID NO: 753389

SEQ ID NO: 753394 - protein, 274 aa, Homo sapiens
AALLLLLNSQPVIFSTPGMQSLLQQITENPQLIQNMLSAPYMRSMMQSLSQNPDLAAQMMLNSPLFTANPQLQEQMRPQLPAFLQQMQNPDTLSAMSNPRAMQALMQIQQGLQTLATEAPGLIPSFTPGVGVGVLGTAIGPVGPVTPIGPIGPIVPFTPIGPIGPIGPTGPAAPPGSTGSGGPTGPTVSSAAPSETTSPTSESGPNQQFIQQMVQALAGANAPQLPNPEVRFQQQLEQLNAMGFLNREANLQALIATGGDINAAIERLLGSQPS

SEQ ID NO: 753395 - protein, 119 aa, Homo sapiens
KPDGARRCGGQTQAHLEKGLAVGGAEGKRNDTIGLPSRWRTRWGVLRGFGEGSARIVALRPRSERHPGLLEPDPQPALVGGEEQRKPRIPISLMANDIKGFHMVICHLHIFSEVSVYVF

SEQ ID NO: 753396 - protein, 109 aa, Homo sapiens
DSLGQTDGESGSYRGPSFPRCKLPVQQLYLQMGWHCHFTPYCFSVITNQTPTEGEAKTMWEQMLHPNSKPVLYVFCWTLLSTPSPAPGVGLGVLWCNPRYGHSSKYFRP

SEQ ID NO: 753397 - protein, 93 aa, Homo sapiens
ADRSSIWVGTIQPAASRARKCTWKSGKRWNKQTCCVFRPSSYSHTGCFLPLNIRLQFWLLDPWTYTSGLPGALGPLGTDCRKYDIIIAKKGEL

SEQ ID NO: 753398 - protein, 70 aa, Homo sapiens
HHLANTLSSPPADKGTIAGEGGLAGGTRVGTRVTRQEVWARSGQHKGKMTLIGALRGHSVEEKHRRLPEV

SEQ ID NO: 753399 - protein, 101 aa, Homo sapiens
VETGFCHVGQAGLKLLTSGDPPALTSQSVGITGMSHRTQPGLLNLKPMMLARISPVSQGLSYLRCAKEEKGVSLLMGQYMCIALITALVLSSPLKGGLAYG

SEQ ID NO: 753400 - protein, 104 aa, Homo sapiens
RAPIHKKEKKPCKPRACWLQIEPPTAPAPQVAPVPAPAPASAKSANVPPARSAAALAAPWAVPSVPRAVSAKAHQRSAAAVPDVGRALLPDINRATSTNLDFFF

SEQ ID NO: 753401 - protein, 82 aa, Homo sapiens
KDKPLSGSKQKNEDYSLSWLQMDPNCSCTTGGSCACAGSCKCKECKCTSCKKCCCSCCPVGCAKCAQGCVCKGSSEKCRCCA

SEQ ID NO: 753402 - protein, 101 aa, Homo sapiens
CGSLLTVGLILNEKRNEKKLEHYPALSCVPNGPQQLLHHRWLLCLRRLLQVQRVQMYLLQEVLLLLLPRGLCQVCPGLCLQRLIREVPLLCLMLGEPCSQT

SEQ ID NO: 753403 - protein, 171 aa, Homo sapiens
MGKSICAVQGVTRGSHGGVPLRSPYSRPATRGGVSGQLSRSASAFKLRLHASQTASKQRPGTAMVQGLTISGQYGTLREGNLCTSTPCFAGLGFLRAALQSKAPPTQISFLAPLLSQVLVLHHELKVFLVWSCSLSLLCFIGVAPNKPFVYLTLYPYIIERDRFIEGDTLK

SEQ ID NO: 753404 - protein, 60 aa, Homo sapiens
MPPSMLSLYPSHVPDSDRRQKANTLYLLVPIRQTMHQQEGKIPRENFESRCQRGLWAEKP

SEQ ID NO: 753405 - protein, 130 aa, Homo sapiens
MRLFTGIVFCSLVMGVTSESWRSFFKEALQGVGDMGRAYWDIMISNHQNSNRYLYARGNYDAAQRGPGGVWAAKLISRSRVYLQGLIDYYLFGNSSTVLEDSKSNEKAEEWGRSGKDPDRFRPDGLPKKY

SEQ ID NO: 753406 - protein, 196 aa, Homo sapiens
LSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKVKCWGPGAFENHSTCHVTFPG

SEQ ID NO: 753407 - protein, 98 aa, Homo sapiens
LSEPDDRYPLIVKIDLNLLTRIPGKPYKETEPPKGEKKNVPEKHTREAQKQASEKVSNKGKRKHKVCEGFLLFVLKHQNLKCGGNLSKPQSNKVGHKL

SEQ ID NO: 753408 - protein, 333 aa, Homo sapiens
LSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKVSMQ

SEQ ID NO: 753409 - protein, 181 aa, Homo sapiens
RNAISFIFNLLTVFIVVIYFFGQEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKVSMQ

SEQ ID NO: 753410 - protein, 118 aa, Homo sapiens
LSEPDDRYPLIVKIDLNLLTRIPGKPYKETEPPKGEKKNVPEKHTREAQKQASEKVSNKGKRKHKNEDDNRASESKKPKTEDKNSAGHKPSSNREYVPKTCCMPVLLIYVYHLIVGTF

SEQ ID NO: 753411 - protein, 277 aa, Homo sapiens
VTGVIDAPPVLQPQSSAGKAVAGWVLWLSSHQAAVLRLGPLPAGSSQEGPAGPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKVSMQ

SEQ ID NO: 753412 - protein, 236 aa, Homo sapiens
MGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 753413 - protein, 548 aa, Homo sapiens
KLQQRKTFASHLIKSSASSHIMLNNLLLFSLQISLIGTTLGGNVLIWPMEGSHWLNVKIIIDELIKKEHNVTVLVASGALFITPTSNPSLTFEIYKVPFGKERIEGVIKDFVSTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGRPTTLCETMGKAEIWLIRTYWDFEFPRPYLPNFEFVGGLHCKPAKPLPKEMEEFIQSSGKNGVVVFSLGSMVKNLTEEKANLIASALAQIPQKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 753414 - protein, 132 aa, Homo sapiens [sequence omitted]

SEQ ID NO: 753415 - protein, 200 aa, Homo sapiens
QSPLSAAGPGSPAPLGALTPAEPGLGSAPRAPRARAPVTGKRRSRRSAVALGSAPAQPGPRERTGRASPVTLQRPHEPAQCLLSVKGHCSPWVTPMMPDRSSCLLEQPGPYEVVTTPVSRGGKWYQSNPGGGGAARSRCREMEEPTPEPVYVDVDKGLTLACFVFLCLFLVVMIIRCAKVIMDPYSAIPTSTWEEQHLDD

SEQ ID NO: 753416 - protein, 256 aa, Homo sapiens
DRSGAPGAAATDRSRTPRAPGPPAHGARHAGGPPLPAGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRFWNTP

SEQ ID NO: 753417 - protein, 1306 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753418 - protein, 748 aa, Homo sapiens
RIGQGTVAAGLCSPAAMGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753419 - protein, 745 aa, Homo sapiens
ENKIRSTLNEIYFGKTKDIVNGLRSVQTFADKSKQEALKNDLVEDFEEKAAMLNLCFMLTRHAVHSLDSFLRKLVFCSLPSSLPSPTGHITAASLTAQRHLSLRIKPIANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753420 - protein, 774 aa, Homo sapiens
RIGQGTVAAGLCSPAAMGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPALKFSELPLQAEVSSGLELKPFKPLPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753421 - protein, 775 aa, Homo sapiens
RIGQGTVAAGLCSPAAMGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILGLYDTWGSSLLCPCLDMCCLTAGIQGELQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753422 - protein, 414 aa, Homo sapiens
RIGQGTVAAGLCSPAAMGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRA

SEQ ID NO: 753423 - protein, 616 aa, Homo sapiens
MQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753424 - protein, 560 aa, Homo sapiens
METTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753425 - protein, 642 aa, Homo sapiens
MQIANHTLKYGTQARKFDVNQLQNTTIKRIIKKVQDLERAALPAQELEEYNKILLDMETTYSVATVCHPNGSCLQLEPALKFSELPLQAEVSKGLELKPFKPLPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753426 - protein, 424 aa, Homo sapiens
MWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753427 - protein, 372 aa, Homo sapiens
RIGQGTVAAGLCSPAAMGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSPLLPAHGCLTLSPTSPSLSVNTIKGPALPI

SEQ ID NO: 753428 - protein, 850 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVGCRDSGRFYVRESIPWSKNWSGFLQEVRHFN

SEQ ID NO: 753429 - protein, 158 aa, Homo sapiens
PRYVIKYLLSGPSGWHGATQMPPATIREIPGPRVLLPQFLQSIGGRKWPGACGPGSRSRLQPESPVPMVPTLPTRKVLQAGSSRPWQEVLKDMVGLDALDAQPLLKYFQPVTQWLQEQNQQNGEVLGWPEYQWHPPLPDNYPEGIGKALSEDGVGLRW

SEQ ID NO: 753430 - protein, 1306 aa, Homo sapiens; identical to SEQ ID NO: 753417

SEQ ID NO: 753431 - protein, 1306 aa, Homo sapiens; identical to SEQ ID NO: 753417

SEQ ID NO: 753432 - protein, 1160 aa, Homo sapiens
MSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753433 - protein, 616 aa, Homo sapiens; identical to SEQ ID NO: 753423

SEQ ID NO: 753434 - protein, 811 aa, Homo sapiens
PRYVIKYLLSGPSGWHGATQMPPATIREIPGPRVLLPQFLQSIGGRKWPGACGPGSRSRLQPESPVPMVPTLPTRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753435 - protein, 627 aa, Homo sapiens
FLVVSSHGICHAVHLRTAERAALPSSLAPHLPAHGAWGQCRPQRDQVQRSTAHCLSFLLQYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753436 - protein, 798 aa, Homo sapiens
RIGQGTVAAGLCSPAAMGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSGPPPTPPPALGLNPLPRLGSHAADLGAWPCPAPLPCPALPCPCCLLASHSARSEGPLPDSGRVSFLGLDLDAQQARVGQWLLLFLGIALLVATLGLSQRLFSIRHRSLHRHSHGPQFGSEVELRHS

SEQ ID NO: 753437 - protein, 252 aa, Homo sapiens
MALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 753438 - protein, 717 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILVGATSPPPNLSMCTHTEMLSRSPHSGAATTF

SEQ ID NO: 753439 - protein, 266 aa, Homo sapiens
RYSHFRGGSEVALFCFEMAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 753440 - protein, 143 aa, Homo sapiens
SAIVIHVHCDATCIVIHVHCDPEHCDQASVSVVDLKAEIDKLATEYMSSARSLSSEEKLALLKQIQEAYGKCKEFGDDKVQLAMQTYEMVWPCSWLPTYFPSNPQGLRPLLQLCWDLFGVCEIHKLCLNLFSLIGDSFVPLLS

SEQ ID NO: 753441 - protein, 200 aa, Homo sapiens
MSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 753442 - protein, 242 aa, Homo sapiens
RYSHFRGGSEVALFCFEMAAGMYLEHYLDNLKAEIDKLATEYMSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 753443 - protein, 200 aa, Homo sapiens; identical to SEQ ID NO: 753441

SEQ ID NO: 753444 - protein, 161 aa, Homo sapiens
RYSHFRGGSEVALFCFEMAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKKVRRGRGCERWGED

SEQ ID NO: 753445 - protein, 266 aa, Homo sapiens; identical to SEQ ID NO: 753439

SEQ ID NO: 753446 - protein, 113 aa, Homo sapiens
TRPWNIIWTVWKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 753447 - protein, 163 aa, Homo sapiens
RYSHFRGGSEVALFCFEMAAGMYLEHYLDSIENLPFELQRNFQLMRDLDQRTEDLKAEIDKLATEYMSSARSLSSEEKLALLKQIQEAYGKCKEFGDDKVQLAMQTYEMVWPCSWLPTYFPSNPQGLRPLLQLCWDLFGVCEIHKLCLNLFSLIGDSFVPLLS

SEQ ID NO: 753448 - protein, 142 aa, Homo sapiens
MSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTSPEYGMPVGGQCPPNWGVGARLEW

SEQ ID NO: 753449 - protein, 266 aa, Homo sapiens; identical to SEQ ID NO: 753439

SEQ ID NO: 753450 - protein, 266 aa, Homo sapiens; identical to SEQ ID NO: 753439

SEQ ID NO: 753451 - protein, 200 aa, Homo sapiens; identical to SEQ ID NO: 753441

SEQ ID NO: 753452 - protein, 266 aa, Homo sapiens; identical to SEQ ID NO: 753439

SEQ ID NO: 753453 - protein, 208 aa, Homo sapiens
RYSHFRGGSEVALFCFEMAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTSPEYGMPVGGQCPPNWGVGARLEW

SEQ ID NO: 753454 - protein, 239 aa, Homo sapiens
CASLRATHRHLYALPFAPVRSKVGSPGEVKLKSSFVTTLKLTLSSLHTGQSQPLNSVLTAHQQALWCFYLTEEDARACPTLSPCQSRAAELWQIWGAVVGVSVSLPHPGLYPPYSLEVESNHRSAGFFLCTWQPLEGKACTFPAVTPAHVSHIISLSCSKNFSPERRWQRWAGGAKVGALTARFQGALLSQPTTMVRQGDSAGLRIRALKMAFVLLVFSLFICCLFSDDVLVKSSFENP

SEQ ID NO: 753455 - protein, 163 aa, Homo sapiens
GLCLSLWSQEDSADLKCQLHFAKEESALMCKKLTKLAKENDSMKEELLKYRSLYGDLDSALSAEELADAPHSRETELKVHLKLVEEEANLLSRRIVELEVENRGLRAEMDDMKDHGGGCGGPEARLAFSALGGGECGESLAELRRHLQFVEEEAELLRRSSAE

SEQ ID NO: 753456 - protein, 117 aa, Homo sapiens
GSEHEQVRDLSCKTHTDGASAYLGRRFKHKLAKTCQTSSMVLFNQQPPDVSEYLCAVNQTSLSLLWADLESVVYTLQYLTASLCLCLNPGGSVIATARPVLMWPRRQLLRQTKPQKV

SEQ ID NO: 753457 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 753458 - protein, 369 aa, Homo sapiens; identical to SEQ ID NO: 753457

SEQ ID NO: 753459 - protein, 345 aa, Homo sapiens [sequence omitted]

SEQ ID NO: 753460 - protein, 318 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSARSGVFKGTG

SEQ ID NO: 753461 - protein, 357 aa, Homo sapiens [sequence omitted]

SEQ ID NO: 753462 - protein, 71 aa, Homo sapiens
VSVDDTGTFLAWSGVSKGLAESLQPDYSERLCLVSEIPPKGGALGEGPGASPCNQHSPYWAPPCYTLKPET

SEQ ID NO: 753463 - protein, 369 aa, Homo sapiens; identical to SEQ ID NO: 753457

SEQ ID NO: 753464 - protein, 343 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLHLKPEPQSSDRRTPGSCSPKWY

SEQ ID NO: 753465 - protein, 379 aa, Homo sapiens
RVVSTQSGHYVRGVSTGTQLRQQLRLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 753466 - protein, 348 aa, Homo sapiens
MGMKTPQLVGNLGLEGADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 753467 - protein, 501 aa, Homo sapiens
MVLWGPVLGALLVVIAGYLCLPGMLRQRRPWEPPLDKGTVPWLGHAMAFRKNMFEFLKRMRTKHGDVFTVQLGGQYFTFVMDPLSFGPILKDTQRKLDFGQYAKKLVLKVFGYRSVQGDHEMIHSASTKHLRGDGLKDLNETMLDSLSFVMLTSKGWSLDASCWHEDSLFRFCYYILFTAGYLSLFGYTKDKEQDLLQAGELFMEFRKFDLLFPRFVYSLLWPREWLEVGRLQRLFHKMLSVSHSQEKEGISNWLGNMLQFLREQGVPSAMQDKFNFMMLWASQGNTGPTSFWALLYLLKHPEAIRAVREEATQVLGEARLETKQSFAFKLGALQHTPVLDSVVEETLRLRAAPTLLRLVHEDYTLKMSSGQEYLFRHGDILALFPYLSVHMDPDIHPEPTVFKYDRFLNPNGSRKVDFFKTGKKIHHYTMPWGSGVSICPGRFFALSEVKLFILLMVTHFDLELVDPDTPLPHVDPQRWGFGTMQPSHDVRFRYRLHPTE

SEQ ID NO: 753468 - protein, 72 aa, Homo sapiens
MTSEQNASPFPHLPSMAFQSVSSSALPRAHFLVQHSCQANRPILVPCPKLCRLGSSCLLLASPALLPSLPGK

SEQ ID NO: 753469 - protein, 148 aa, Homo sapiens
TLLGEVSAAGCGFSFLQRLTQVGMGSFSGSESGCDAWNAAAILAPEGDANMWRKAEQTAEQQNWACMLCPERARQSTAQPIPGQKNGTAWKAGPNRTCPLGLGRGPDEGCRTGWTPRPLLPAVTTSVWVVGTCLNFILSTVYKFCNKP

SEQ ID NO: 753470 - protein, 106 aa, Homo sapiens
MASSGAGDPLDSKRGEAPFAQRIDPTREKLTPEQLHSMRQAELAQWQKVLPRRRTRNIVTGLGIGALVLAIYGYTFYSISQERFLDELEDEAKAARARALARASGS

SEQ ID NO: 753471 - protein, 106 aa, Homo sapiens; identical to SEQ ID NO: 753470

SEQ ID NO: 753472 - protein, 106 aa, Homo sapiens; identical to SEQ ID NO: 753470

SEQ ID NO: 753473 - protein, 106 aa, Homo sapiens; identical to SEQ ID NO: 753470

SEQ ID NO: 753474 - protein, 106 aa, Homo sapiens; identical to SEQ ID NO: 753470

SEQ ID NO: 753475 - protein, 119 aa, Homo sapiens
GNMASSGAGDPLDSKRGEAPFAQRIDPTREKLTPEQLHSMRQAELAQWQKVLPRRRTRNIVTGLGIGALVLAICIRPCCRLKGTAYRGRGTECARGLNHPFNFGVKWVVLSFVIPKVLF

SEQ ID NO: 753476 - protein, 106 aa, Homo sapiens; identical to SEQ ID NO: 753470

SEQ ID NO: 753477 - protein, 106 aa, Homo sapiens; identical to SEQ ID NO: 753470

SEQ ID NO: 753478 - protein, 106 aa, Homo sapiens; identical to SEQ ID NO: 753470

SEQ ID NO: 753479 - protein, 361 aa, Homo sapiens
MDPLGAAKPQWPWRRCLAALLFQLLVAVCFFSYLRVSRDDATGSPRAPSGSSRQDTTPTRPTLLILLWTWPFHIPVALSRCSEMVPGTADCHITADRKVYPQADTVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 753480 - protein, 361 aa, Homo sapiens; identical to SEQ ID NO: 753479

SEQ ID NO: 753481 - protein, 361 aa, Homo sapiens; identical to SEQ ID NO: 753479

SEQ ID NO: 753482 - protein, 361 aa, Homo sapiens; identical to SEQ ID NO: 753479

SEQ ID NO: 753483 - protein, 361 aa, Homo sapiens; identical to SEQ ID NO: 753479

SEQ ID NO: 753484 - protein, 96 aa, Homo sapiens
KKEDTEEGKRGKVRRGGSGDHQEGNRETEEVWVARACEKEVQSRVGDRDGGGVEQLGEEPGSAGRDGMDRSSVQAGGGAAVQGGRWTVWGPDKLHN

SEQ ID NO: 753485 - protein, 119 aa, Homo sapiens
PLYSSLGGRVRLCPQKTNKQTKNHITPRDCNHLRASHCTWPDVQTLFSGDPNPPRSRPSLPPHPRFFPHPLICRAATMQAFSCSSDTPSLVPPYGFAFAVPYVCNARPEPGFPGSGNRG

SEQ ID NO: 753486 - protein, 925 aa, Homo sapiens
AGTGHARRAVGTGCERAGGSRLHRQQLARRSRPARGRRCARLGDRCSLAGCRRRLRGSRTTGWARIRLGGFLPVPSHLVWARGVSGESRGPEGGSENTQVKDTMNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGKQKRRPDALRMISNADPSIPPPPRAPAPAPPGTVTQVDVRSRVAAWSAWAADQGDFEKPRQYHEQEETPEMMAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKQLPVDRRKSQMEEVQDELIHRLTIGRSAAQKKFHVPRQNVPVINITYDSTPEDVKTWLQSKGFNPVTVNSLGVLNGAQLFSLNKDELRTVCPEGARVYSQITVQKAALEDSSGSSELQEIMRRRQEKISAAASDSGVESFDEGSSH

SEQ ID NO: 753487 - protein, 879 aa, Homo sapiens
AGTGHARRAVGTGCERAGGSRLHRQQLARRSRPARGRRCARLGDRCSLAGCRRRLRGSRTTGWARIRLGGFLPVPSHLVWARGVSGESRGPEGGSENTQVKDTMNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGKQKRRPDALSWKPRQYHEQEETPEMMAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKQLPVDRRKSQMEEVQDELIHRLTIGRSAAQKKFHVPRQNVPVINITYDSTPEDVKTWLQSKGFNPVTVNSLGVLNGAQLFSLNKDELRTVCPEGARVYSQITVQKAALEDSSGSSELQEIMRRRQEKISAAASDSGVESFDEGSSH

SEQ ID NO: 753488 - protein, 925 aa, Homo sapiens; identical to SEQ ID NO: 753486

SEQ ID NO: 753489 - protein, 561 aa, Homo sapiens
MAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKQLPVDRRKSQMEEVQDELIHRLTIGRSAAQKKFHVPRQNVPVINITYDSTPEDVKTWLQSKGFNPVTVNSLGVLNGAQLFSLNKDELRTVCPEGARVYSQITVQKAALEDSSGSSELQEIMRRRQEKISAAASDSGVESFDEGSSH

SEQ ID NO: 753490 - protein, 416 aa, Homo sapiens [sequence omitted]

SEQ ID NO: 753491 - protein, 136 aa, Homo sapiens [sequence omitted]

SEQ ID NO: 753492 - protein, 291 aa, Homo sapiens
TLPETPPLPLRSEMRGLTVAKRGFDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKQLPVDRRKSQMEEVQDELIHRLTIGRSAAQKKFHVPRQNVPVINITYDSTPEDVKTWLQSKGFNPVTVNSLGVLNGAQLFSLNKDELRTVCPEGARVYSQITVQKAALEDSSGSSELQEIMRRRQEKISAAASDSGVESFDEGSSH

SEQ ID NO: 753493 - protein, 276 aa, Homo sapiens
AGTGHARRAVGTGCERAGGSRLHRQQLARRSRPARGRRCARLGDRCSLAGCRRRLRGSRTTGWARIRLGGFLPVPSHLVWARGVSGESRGPEGGSENTQVKDTMNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKI

SEQ ID NO: 753494 - protein, 925 aa, Homo sapiens; identical to SEQ ID NO: 753486

SEQ ID NO: 753495 - protein, 854 aa, Homo sapiens
AGTGHARRAVGTGCERAGGSRLHRQQLARRSRPARGRRCARLGDRCSLAGCRRRLRGSRTTGWARIRLGGFLPVPSHLVWARGVSGESRGPEGGSENTQVKDTMNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGKQKRRPDALRMISNADPSIPPPPRAPAPAPPGTVTQVDVRSRVAAWSAWAADQGDFEKPRQYHEQEETPEMMAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQGWSMGQEPVDMPLVPKLLQTSPGLDPVRMSMQHRARGKRSRHYRRSKTAIRGQHGGDELLERQHRTQTSAWTTRNPTEGRQRNHQTRRVRPHNHAAGRGPQHQTTGDVSVAYNDSTDESNQEEQRTTLGSLIKATHHYLKNK

SEQ ID NO: 753496 - protein, 352 aa, Homo sapiens
AGTGHARRAVGTGCERAGGSRLHRQQLARRSRPARGRRCARLGDRCSLAGCRRRLRGSRTTGWARIRLGGFLPVPSHLVWARGVSGESRGPEGGSENTQVKDTMNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGKQKRRPDALRMISNADPSIPPPPRAPAPAPPGTVTQVDVRSRVAAWSAWAADQGDCESS

SEQ ID NO: 753497 - protein, 172 aa, Homo sapiens
GGSRLHRQQLARRSRPARGRRCARLGDRCSLAGCRRRLRGSRTTGWARIRLGGFLPVPSHLVWARGVSGESRGPEGGSEVRAPWRKAPVPGSGGFDFLDFKNPPLCAGIGAVPGAASASLHFDCFQLVLAARCGRALRPEASARRVRASCGARADPRPGLREAGQGGFAVAQ

SEQ ID NO: 753498 - protein, 119 aa, Homo sapiens
MAWRVPGVRPASTFFPQVLRASSELPNRLPEGSTVGPKPDSSWEAGSQGNWGLTSSGAGQDSSAQKLGILSVQISLKIWTWEKPSGWGHLHAAVTGASCCSPLSQGGCHLPCHCSSGQA

SEQ ID NO: 753499 - protein, 350 aa, Homo sapiens
MGCFFSKRRKADKESRPENEEERPKQYSWDQREKVDPKDYMFSGLKDETVGRLPGTVAGQQFLIQDCENCNIYIFDHSATVTIDDCTNCIIFLGPVKGSVFFRNCRDCKCTLACQQFRVRDCRKLEVFLCCATQPIIESSSNIKFGCFQWYYPELAFQFKDAGLSIFNNTWSNIHDFTPVSGELNWSLLPEDAVVQDYVPIPTTEELKAVRVSTEANRSIVPISRGQRQKSSDESCLVVLFAGDYTIANARKLIDEMVGKGFFLVQTKEVSMKAEDAQRVFREKAPDFLPLLNKGPVIALEFNGDGAVEVCQLIVNEIFNGTKMFVSESKETASGDVDSFYNFADIQMGI

SEQ ID NO: 753500 - protein, 103 aa, Homo sapiens
MEKAAQVTMLRPPSSQKLAPLGIGNCWLILEQSSLGMEKEEEAALTLGSDERVLQKLAELSNTLITKASGHLRSGGHGTVVPEPAQDTFKCPQKDIPGEPMKG

SEQ ID NO: 753501 - protein, 104 aa, Homo sapiens
MVQQLPLLLQEGNMKHSRAVWKCEQPRLGESHMFPCSSQELQNGLQPSVLLNNITHLKQRIHGPSRSKLLTQLKSMENVSYGISTNIPSKGKRLCPSEDEEYLR

SEQ ID NO: 753502 - protein, 727 aa, Homo sapiens
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFGGSLTYDHMDWLNKRLVFEKFTKESTSLLDELALINNGSDKGNQQEKERSVDLNFLPSVDPETVLQTGHELLSELQQRRFNGSDGGVSWSPMDDELLAQPQVMKLLDSLREQYTRYQEVCRQRSKRTQLEEIQQKVMQVVNWLEGPGSEQLRAQWGIGDSIRASQALQQKHEEIESQHSEWFAVYVELNQQIAALLNAGDEEDLVELKSLQQQLSDVCYRQASQLEFRQNLLQAALEFHGVAQDLSQQLDGLLGMLCVDVAPADGASIQQTLKLLEEKLKSVDVGLQGLREKGQGLLDQISNQASWAYGKDVTIENKENVDHIQGVMEDMQLRKQRCEDMVDVRRLKMLQMVQLFKCEEDAAQAVEWLSELLDALLKTHIRLGDDAQETKVLLEKHRKFVDVAQVQNWLSSFSTSSVFESFLHDYNVTLPSKYKKSTYDYGRQLLQATVVLCQSLRCTSRSSGDTLPRLNRVWKQFTIASEERVHRLEMAIAFHSNAEKILQDCPEEPEAINDEEQFDEIEAVGKSLLDRLTVPVVYPDGTEQYFGSPSDMASTAENIRDRMKLVNLKRQQLRHPEMVTTES

SEQ ID NO: 753503 - protein, 127 aa, Homo sapiens
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEEDIL

SEQ ID NO: 753504 - protein, 62 aa, Homo sapiens
SRVSPYPGCTSRSSGDTLPRLNRVWKQFTIASEERVHRLEMAIAFHSNAEKILQDCPEVRLG

SEQ ID NO: 753505 - protein, 696 aa, Homo sapiens
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFGGSLTYDHMDWLNKRLVFEKFTKESTSLLDELALINNGSDKGNQQEKERSVDLNFLPSVDPETVLQTGHELLSELQQRRFNGSDGGVSWSPMDDELLAQPQVMKLLDSLREQYTRYQEVCRQRSKRTQLEEIQQKVMQVVNWLEGPGSEQLRAQWGIGDSIRASQALQQKHEEIESQHSEWFAVYVELNQQIAALLNAGDEEDLVELKSLQQQLSDVCYRQASQLEFRQNLLQAALEFHGVAQDLSQQLDGLLGMLCVDVAPADGASIQQTLKLLEEKLKSVDVGLQGLREKGQGLLDQISNQASWAYGKDVTIENKENVDHIQGVMEDMQLRKQRCEDMVDVRRLKMLQMVQLFKCEEDAAQAVEWLSELLDALLKTHIRLGDDAQETKVLLEKHRKFVDVAQSTYDYGRQLLQATVVLCQSLRCTSRSSGDTLPRLNRVWKQFTIASEERVHRLEMAIAFHSNAEKILQDCPEEPEAINDEEQFDEIEAVGKSLLDRLTVPVVYPDGTEQYFGSPSDMASTAENIRDRMKLVNLKRQQLRHPEMVTTES

SEQ ID NO: 753506 - protein, 696 aa, Homo sapiens; identical to SEQ ID NO: 753505

SEQ ID NO: 753507 - protein, 334 aa, Homo sapiens
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFGGSLTYDHMDWLNKRLVFEKFTKESTSLLDELALINNGSDKGNQQEKERSVDLNFLPSVDPETVLQTGHELLSELQQRRFNGSDGGVSWSPMDDELLAQPQVMKLLDSLREQYTRYQEVCRQRSKRTQLEEIQQKVMQVVNWLEGPGSEQLRAQWGIGDSIRASQALQQKHEEIESQHSVRGFFLCKLQ

SEQ ID NO: 753508 - protein, 182 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMGSCDFSIRTYTYADTPDDFQ

SEQ ID NO: 753509 - protein, 182 aa, Homo sapiens; identical to SEQ ID NO: 753508

SEQ ID NO: 753510 - protein, 182 aa, Homo sapiens; identical to SEQ ID NO: 753508

SEQ ID NO: 753511 - protein, 120 aa, Homo sapiens
SHLRLQKEQLAPGSNVPSSCLTASSPLPSFLGSKWTPTAPAPLGAPAPVPAPASAKSANEPPARRAAAPAAPWAVPSVPRAASAKGRRRSAAAVPDVGTALLPDVNRATCTNLDFFFIQP

SEQ ID NO: 753512 - protein, 120 aa, Homo sapiens; identical to SEQ ID NO: 753511

SEQ ID NO: 753513 - protein, 85 aa, Homo sapiens
GRLLLLNSRPRRPRNGPQLLLRHWGLLLLCQLLQVQRVQMNLLQEELLLLLPHGLCQVCPGLRLQRGVGEVQLLCLMWGQPCSQM

SEQ ID NO: 753514 - protein, 81 aa, Homo sapiens
QEEPLNEIISMAELGAREGVGVDFSSCESHSISTWKLRKREGVEKNQTRDTVPDAFPSGCALLLFAEEWLWSAPAALDGLP

SEQ ID NO: 753515 - protein, 72 aa, Homo sapiens
RHLLQEVEVTWKVTLILPPPHRVSAYPLYRLECLAWVPGPLRASVSPPVILVRTQPLPAHLHGAGATKQTGS

SEQ ID NO: 753516 - protein, 75 aa, Homo sapiens
GKGLSVGEGYTREDRHLGFIDTTLDARSHCHYFPVTFPPSFFHQATNSKVMVTLRLPALCGVHDNTCETYTCFSS

SEQ ID NO: 753517 - protein, 586 aa, Homo sapiens
AALGRKCRSAAGAKRGRRAALAGEAGGLSVAAAGKPRGGGARPGTSPGPAPPSLSMDEESLESALQTYRAQLQQVELALGAGLDSSEQADLRQLQGDLKELIELTEASLVSVRKSRLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSAQSSALCPSLAVVGSDAVDSGTCSSAFAGWEVHTRGIGSRLLTKVGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQERRKADTHKKMTEF

SEQ ID NO: 753518 - protein, 563 aa, Homo sapiens
GGAREEVPIGCWGEKGAPGRSSRPGPAPPSLSMDEESLESALQTYRAQLQQVELALGAGLDSSEQADLRQLQGDLKELIELTEASLVSVRKSRLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSAQSSALCPSLAVVGSDAVDSGTCSSAFAGWEVHTRGIGSRLLTKVGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQERRKADTHKKMTEF

SEQ ID NO: 753519 - protein, 101 aa, Homo sapiens
KTPKPFQRSSRLPLPLLAQSSKRAEWFGMTSCCPGLPWVSSPHISGAAFLSHPSCGSGGHRCDVEGKSHKPWQHTHGTNFAGVQNAKAEGACLLPPTFQRV

SEQ ID NO: 753520 - protein, 695 aa, Homo sapiens
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLAESEQAPPTEPKAEEPLAAVTPAVGLDLGMDTRAEEPVEEAVIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 753521 - protein, 653 aa, Homo sapiens
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 753522 - protein, 651 aa, Homo sapiens
SSSVPGLLAKNVRTTQVRAEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 753523 - protein, 868 aa, Homo sapiens
ACLEQQRLQGQAATMSLSEEQARSFLDQNPDFARQYFGKKLSPENVGRGCEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLNGPFFTSEDEDVFLKYLNFATLYLKIYHLSYLHNCETRRGQVLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 753524 - protein, 951 aa, Homo sapiens
MLHSQTLGGGHRRPDVRKPRPDVLKALLAAGGSGAAGRRKGWSDVCLSSSKRQIPLSTRPLLSDQGHDRSLEASPPASSRAPQAQMKPGHGATNQGLCQAPRLGRWSDQGAHLCQAGVKPLLLWSDRREGGSGHRPQVCPSLQVLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEEVGILTLGFCCGRWGRSVLQAQGRILRRLLMQRVSTGCVSTGGGRQRRRRAEAEGRCIGGPGKTLVGKTLERPLMGWGGSRRGSGPGPTSGGMKGSRALSGPQGPGHSVDPSLRSPVVTSEAICVPSRRWSRWWRAGHPEEGPEQQAIRGPAHRGPEGGGVRGTGSRGEGAGSPGTLRGGRRRLTRWALPPQTLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 753525 - protein, 992 aa, Homo sapiens
AAAASVRRQGWWGLGLGLDQGGRERWPKEGPGVSLSLVAALTQQPGACAAGCPEWGLARTSWSASAMLHSQTLGGGHRRPDVRKPRPDVLKALLAAGGSGAAGRRKGWSDVCLSSSKRQIPLSTRPLLSDQGHDRSLEASPPASSRAPQAQMKPVSGLSKPLLLWSDRREGGSGHRPQVCPSLQVLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEEVGILTLGFCCGRWGRSVLQAQGRILRRLLMQRVSTGCVSTGGGRQRRRRAEAEGRCIGGPGKTLVGKTLERPLMGWGGSRRGSGPGPTSGGMKGSRALSGPQGPGHSVDPSLRSPVVTSEAICVPSRRWSRWWRAGHPEEGPEQQAIRGPAHRGPEGGGVRGTGSRGEGAGSPGTLRGGRRRLTRWALPPQTLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 753526 - protein, 799 aa, Homo sapiens
MGEAGVRVLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEEVGILTLGFCCGRWGRSVLQAQGRILRRLLMQRVSTGCVSTGGGRQRRRRAEAEGRCIGGPGKTLVGKTLERPLMGWGGSRRGSGPGPTSGGMKGSRALSGPQGPGHSVDPSLRSPVVTSEAICVPSRRWSRWWRAGHPEEGPEQQAIRGPAHRGPEGGGVRGTGSRGEGAGSPGTLRGGRRRLTRWALPPQTLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 753527 - protein, 541 aa, Homo sapiens
MLHSQTLGGGHRRPDVRKPRPDVLKALLAAGGSGAAGRRKGWSDVCLSSSKRQIPLSTRPLLSDQGHDRSLEASPPASSRAPQAQMKPGHGATNQGLCQAPRLGRWSDQGAHLCQAGVKPLLLWSDRREGGSGHRPQVCPSLQVLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKVGTSGRACELALNQLHALGILGFA

SEQ ID NO: 753528 - protein, 868 aa, Homo sapiens; identical to SEQ ID NO: 753523

SEQ ID NO: 753529 - protein, 868 aa, Homo sapiens; identical to SEQ ID NO: 753523

SEQ ID NO: 753530 - protein, 1033 aa, Homo sapiens
MLHSQTLGGGHRRPDVRKPRPDVLKALLAAGGSGAAGRRKGWSDVCLSSSKRQIPLSTRPLLSDQGHDRSLEASPPASSRAPQAQMKPGHGATNQGLCQAPRLGRWSDQGAHLCQAGVKPLLLWSDRREGGSGHRPQVCPSLQVLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEEVGILTLGFCCGRWGRSVLQAQGRILRRLLMQRVSTGCVSTGGGRQRRRRAEAEGRCIGGPGKTLVGKTLERPLMGWGGSRRGSGPGPTSGGMKGSRALSGPQGPGHSVDPSLRSPVVTSEAICVPSRRWSRWWRAGHPEEGPEQQAIRGPAHRGPEGGGVRGTGSRGEGAGSPGTLRGGRRRLTRWALPPQTLNIYQNLNRRQHEHVIHLMDIAIIATDLALYFKCARLPGGGASRGGRVAWDPRQIMGAHGRHSPGDAAPDSVPARRPRAPRMGPRSGSAPPCRRALGAGSPHLLPPAPPLFPGFRKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 753531 - protein, 332 aa, Homo sapiens
MGWGGSRRGSGPGPTSGGMKGSRALSGPQGPGHSVDPSLRSPVVTSEAICVPSRRWSRWWRAGHPEEGPEQQAIRGPAHRGPEGGGVRGTGSRGEGAGSPGTLRGGRRRLTRWALPPQTLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 753532 - protein, 410 aa, Homo sapiens
MLHSQTLGGGHRRPDVRKPRPDVLKALLAAGGSGAAGRRKGWSDVCLSSSKRQIPLSTRPLLSDQGHDRSLEASPPASSRAPQAQMKPGHGATNQGLCQAPRLGRWSDQGAHLCQAGVKPLLLWSDRREGGSGHRPQVCPSLQVLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILVRTLLPVPPMEAGHV

SEQ ID NO: 753533 - protein, 506 aa, Homo sapiens
INTEAASDPLEPRSPPSPAPTPPPAHAPPPPRPSLIPHQLRHPRGLPPGALSRPPKKRRSPLLAHPFPSSLPPPPELSLSHAFPLHHGSPLGCRLPGSCVRSERRRWRRWRRRRQLGSAMTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDELTRHLRIHTGHKPFQCRICMRSFSRSDHLTTHIRTHTGEKPFACEFCGRKFARSDERKRHAKIHLKQKEKKAEKGGAPSASSAPPVSLAPVVTTCA

SEQ ID NO: 753534 - protein, 506 aa, Homo sapiens; identical to SEQ ID NO: 753533

SEQ ID NO: 753535 - protein, 103 aa, Homo sapiens [sequence omitted]

SEQ ID NO: 753536 - protein, 352 aa, Homo sapiens
MTSSLLLAFLLLAPTTVATPRAGGQCPACGGPTLELESQRELLLDLAKRSILDKLHLTQRPTLNRPVSRAALRTALQHLHGVPQGALLEDNREQECEIISFAETGLSTINQTRLDFHFSSDRTAGDREVQQASLMFFVQLPSNTTWTLKVRVLVLGPHNTNLTLATQYLLEVDASGWHQLPLGPEAQAACSQGHLTLELVLEGQVAQSSVILGGAAHRPFVAARVRVGGKHQIHRRGIDCQGGSRMCCRQEFFVDFREIGWHDWIIQPEGYAMNFCIGQCPLHIAGMPGIAASFHTAVLNLLKANTAAGTTGGGSCCVPTARRPLSLLYYDRDSNIVKTDIPDMVVEACGCS

SEQ ID NO: 753537 - protein, 352 aa, Homo sapiens; identical to SEQ ID NO: 753536

SEQ ID NO: 753538 - protein, 588 aa, Homo sapiens
MGGTARGPGRKDAGPPGAGLPPQQRRLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPASAFQGLGSKLPPVVGIANKLKANLMSETNGSIPLCSVLPKLIS

SEQ ID NO: 753539 - protein, 568 aa, Homo sapiens
MKWKEKLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPASAFQGLGSKLPPVVGIANKLKANLMSETNGSIPLCSVLPKLIS

SEQ ID NO: 753540 - protein, 568 aa, Homo sapiens; identical to SEQ ID NO: 753539

SEQ ID NO: 753541 - protein, 568 aa, Homo sapiens; identical to SEQ ID NO: 753539

SEQ ID NO: 753542 - protein, 534 aa, Homo sapiens
MKWKEKLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPERSQNYKCIV

SEQ ID NO: 753543 - protein, 383 aa, Homo sapiens
QIVYLYIQRIIRVFHGVNAPDNPLKEEHLVQLNETDILRVLDGNTGGTYGGHIPGSDRAGLNRHDKSENPGRIYAGGSSTAAGDPSLLSAARIMAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGILGPRLCTEASAGGQSCCGRPSPGTVCPAPWCVAPCVRASGCPGVSHMAGRTGPISSR

SEQ ID NO: 753544 - protein, 411 aa, Homo sapiens
LFFIESLLKRGGPVRIPGIMAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 753545 - protein, 485 aa, Homo sapiens
QIVYLYIQRIIRVFHGVNAPDNPLKEEHLVQLNETDILRVLDGNTGGTYGGHIPGSDRAGLNRHDKSENPGRIYAGGSSTAAGDPSLLSAARIMAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 753546 - protein, 352 aa, Homo sapiens
MTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 753547 - protein, 352 aa, Homo sapiens; identical to SEQ ID NO: 753546

SEQ ID NO: 753548 - protein, 392 aa, Homo sapiens
MAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 753549 - protein, 392 aa, Homo sapiens; identical to SEQ ID NO: 753548

SEQ ID NO: 753550 - protein, 288 aa, Homo sapiens [sequence omitted]

SEQ ID NO: 753551 - protein, 411 aa, Homo sapiens; identical to SEQ ID NO: 753544

SEQ ID NO: 753552 - protein, 192 aa, Homo sapiens [sequence omitted]

SEQ ID NO: 753553 - protein, 183 aa, Homo sapiens [sequence omitted]

SEQ ID NO: 753554 - protein, 81 aa, Homo sapiens
MKAFKGKDQQVRLFRPWLNMDRMLRSAMRLCLPSFDKLELLECIRRLIEVDKDWVPDAAGTSLYVRPVLIGNEVGPTPGLG

SEQ ID NO: 753555 - protein, 411 aa, Homo sapiens; identical to SEQ ID NO: 753544

SEQ ID NO: 753556 - protein, 352 aa, Homo sapiens; identical to SEQ ID NO: 753546

SEQ ID NO: 753557 - protein, 390 aa, Homo sapiens
MPQRSGIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 753558 - protein, 300 aa, Homo sapiens
MAAAALGQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 753559 - protein, 472 aa, Homo sapiens
LFFIESLLKRGGPVRIPGIMAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYQEQIMAFLIEALESGLSVLLCGLENPLGLNHPFLGAPGALDMSSALETPSCDPLRLLGALYGIRAHEWMFPV

SEQ ID NO: 753560 - protein, 371 aa, Homo sapiens
KLLSVPLLSPTTPPTFADLQLPQASPPPPPPPPPPPPPPPPPLPPPHLPSPPPPPPPTPPPPPPPPPPPPPPPPPPPLPHPPPPPHPPPPPPPPPPPPLPPLPPPPTPPPPPPPPPTPPPPPTPSPPPPPPPPPPPPPPPPPHPPTPPPPPPPTPPPPPPHPPPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 753561 - protein, 183 aa, Homo sapiens [sequence omitted]

SEQ ID NO: 753562 - protein, 899 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEVKKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQRKAPAPQRTKAGSKSASRTHRGSHRKDPSLPAASSSSSSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEFQAKHMDQPLPTAIGLYKNHPLYALKRHLLKYEAIYPETAAILGYCRGEAVYSRDCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEKL

SEQ ID NO: 753563 - protein, 36 aa, Homo sapiens
MQEVDSLLMKRRGPALKQKRPGYWLPPGLKTEKMKK

SEQ ID NO: 753564 - protein, 940 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEELSEPVLGDVRESTAFSRSLLPVKPVEIEIETPEQAKTRERSEKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQRKAPAPQRTKAGSKSASRTHRGSHRKDPSLPAASSSSSSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEFQAKHMDQPLPTAIGLYKNHPLYALKRHLLKYEAIYPETAAILGYCRGEAVYSRDCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEKL

SEQ ID NO: 753565 - protein, 374 aa, Homo sapiens
MDPLGPAKPQWLWRRCLAGLLFQLLVAVCFFSYLRVSRDDATGSPRPGLMAVEPVTGAPNGSRCQDSMATPAHPTLLILLWTWPFNTPVALPRCSEMVPGAADCNITADSSVYPQADAVIVHHWDIMYNPSANLPPPTRPQGQRWIWFSMESPSNCRHLEALDGYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQQESRYQTVRSIAAWFT

SEQ ID NO: 753566 - protein, 113 aa, Homo sapiens
MFRIVIPFPFSLFLRWSLSLCCPGWSVVDGNSGPSGPSGVATAKMLAAARRLCPCCELHRARGSGDKQEPSSFQVGGWELPRHSCSCPSHGCWLSLPVFLETRSRQEPCSPGC

SEQ ID NO: 753567 - protein, 245 aa, Homo sapiens
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAFLPKMLAQKSGNIINMSSVASSVKGVVNRCVYSTTKAAVIGLTKSVAADFIQQGIRCNCVCPGTVDTPSLQERIQARGNPEEARNDFLKRQKTGRFATAEEIAMLCVYLASDESAYVTGNPVIIDGGWSL

SEQ ID NO: 753568 - protein, 173 aa, Homo sapiens
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAFLPKMLAQKSGNIINMSSVASSVKGGSVSFRGLRCSYTHIIKSSAFGNRHSRDYNFKY

SEQ ID NO: 753569 - protein, 245 aa, Homo sapiens; identical to SEQ ID NO: 753567

SEQ ID NO: 753570 - protein, 173 aa, Homo sapiens; identical to SEQ ID NO: 753568

SEQ ID NO: 753571 - protein, 245 aa, Homo sapiens; identical to SEQ ID NO: 753567

SEQ ID NO: 753572 - protein, 207 aa, Homo sapiens
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAFLPKMLAQKSGNIINMSSVASSVKGTVDTPSLQERIQARGNPEEARNDFLKRQKTGRFATAEEIAMLCVYLASDESAYVTGNPVIIDGGWSL

SEQ ID NO: 753573 - protein, 245 aa, Homo sapiens; identical to SEQ ID NO: 753567

SEQ ID NO: 753574 - protein, 173 aa, Homo sapiens; identical to SEQ ID NO: 753568

SEQ ID NO: 753575 - protein, 245 aa, Homo sapiens; identical to SEQ ID NO: 753567

SEQ ID NO: 753576 - protein, 173 aa, Homo sapiens; identical to SEQ ID NO: 753568

SEQ ID NO: 753577 - protein, 253 aa, Homo sapiens
MAAAFRKAAKSRQREHRERSQPGFRKHLGLLEKKKDYKLRADDYRKKQEYLKALRKKALEKNPDEFYYKMTRVKLQDGVHIIKETKEEVTPEQLKLMRTQDVKYIEMKRVAEAKKIERLKSELHLLDFQGKQQNKHVFFFDTKKEVEQFDVATHLQTAPELVDRVFNRPRIETLQKEKVKGVTNQTGLKRIAKERQKQYNCLTQRIEREKKLFVIAQKIQTRKDLMDKTQKVKVKKETVNSPAIYKFQSRRKR

SEQ ID NO: 753578 - protein, 230 aa, Homo sapiens
MAAAFRKAAKSRQREHRERSQPGFRKHLGLLEKKKDYKLRADDYRKKQEYLKALRKKALEKNPDEFYYKMTRVKLQDGVHIIKETKEEVTPEQLKLMRTQDVKYIEMKRVAEAKKIERLKSELHLLDFQGKQQNKHVFFFDTKKEVEQFDVATHLQTAPELVDRVFNRPRIETLQKEKVKGVTNQTGLKRIAKERQKQYNCLTQRIEREKKLFVIAQKIQTRKDLMVNPK

SEQ ID NO: 753579 - protein, 184 aa, Homo sapiens
MTRVKLQDGVHIIKETKEEVTPEQLKLMRTQDVKYIEMKRVAEAKKIERLKSELHLLDFQGKQQNKHVFFFDTKKEVEQFDVATHLQTAPELVDRVFNRPRIETLQKEKVKGVTNQTGLKRIAKERQKQYNCLTQRIEREKKLFVIAQKIQTRKDLMDKTQKVKVKKETVNSPAIYKFQSRRKR

SEQ ID NO: 753580 - protein, 253 aa, Homo sapiens; identical to SEQ ID NO: 753577

SEQ ID NO: 753581 - protein, 113 aa, Homo sapiens
MAAAFRKAAKSRQREHRERSQPGFRKHLGLLEKKKDYKLRADDYRKKQEYLKALRKKALEKNPDEFYYKMTRVKLQEEYIIIKGGEGEKTPPFYTKKRRGAPIRTPNILERKR

SEQ ID NO: 753582 - protein, 698 aa, Homo sapiens
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLKEGLGASEAVADIKFSSAGWVSVTPNFKDRLHLRGYTPEGTVLTVRPPLLPYIVNIKGQRIKKSVAYKTKKPPSLMYNVRKKKGKINV

SEQ ID NO: 753583 - protein, 694 aa, Homo sapiens
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLKEGLGASEAVADIKFSSAGWVSVTPNFKDRLHLRGYTPEGTVLTVRPPLLPYIVNIKGQRIKKSVAYKTKKPPSLMLPPGRPLK

SEQ ID NO: 753584 - protein, 636 aa, Homo sapiens
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLKEGLGASEAVADIKFSSAGNFMPSTF

SEQ ID NO: 753585 - protein, 659 aa, Homo sapiens
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQIPMGGKERMAGFPPLVAEDIMLKEGLGASEAVADIKFSSAGWVSVTPNFKDRLHLRGYTPEGTVLTVRPPLLPYIVNIKGQRIKKSVAYKTKKPPSLMYNVRKKKGKINV

SEQ ID NO: 753586 - protein, 532 aa, Homo sapiens
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCISFLRQRVHMFAHVMFKLCLTDVCWEA

SEQ ID NO: 753587 - protein, 698 aa, Homo sapiens; identical to SEQ ID NO: 753582

SEQ ID NO: 753588 - protein, 659 aa, Homo sapiens; identical to SEQ ID NO: 753585

SEQ ID NO: 753589 - protein, 680 aa, Homo sapiens
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLSWVSVTPNFKDRLHLRGYTPEGTVLTVRPPLLPYIVNIKGQRIKKSVAYKTKKPPSLMYNVRKKKGKINV

SEQ ID NO: 753590 - protein, 479 aa, Homo sapiens
MVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLKEGLGASEAVADIKFSSAGWVSVTPNFKDRLHLRGYTPEGTVLTVRPPLLPYIVNIKGQRIKKSVAYKTKKPPSLMYNVRKKKGKINV

SEQ ID NO: 753591 - protein, 452 aa, Homo sapiens
PGCTRAAEPLPPLRILPGGSAARNSGDAAPCSPEPHSKSAMGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGGRPPPPGPALRARPLSPVLPPGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 753592 - protein, 455 aa, Homo sapiens
PGCTRAAEPLPPLRILPGGSAARNSGDAAPCSPEPHSKSAMGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGESLCRAGGRGPGGPEPGVLPTLPTGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 753593 - protein, 214 aa, Homo sapiens
GELAHGRRGWARGSQALTPGARSVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 753594 - protein, 127 aa, Homo sapiens
PQDQNQAGARGQERDLPLRPEDPPQERESVVSERPGRSSGWAARGRPWGRGAGQAAGGGCACRNAPPPCSWYKDQEPLEFSYPGYLALGEAHLSIIANAVNEGTYTCVVRRQQRVLTTYSWRVRVRG

SEQ ID NO: 753595 - protein, 430 aa, Homo sapiens
PGCTRAAEPLPPLRILPGGSAARNSGDAAPCSPEPHSKSAMGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 753596 - protein, 471 aa, Homo sapiens
PGCTRAAEPLPPLRILPGGSAARNSGDAAPCSPEPHSKSAMGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGDRPGSSWRPLLCSTVGCRGRALGQTAGGTFRGGGCHWSLAGVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 753597 - protein, 391 aa, Homo sapiens
PGCTRAAEPLPPLRILPGGSAARNSGDAAPCSPEPHSKSAMGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGGRPPPPRPGPARPASQPRAPPRLLPDQPHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 753598 - protein, 125 aa, Homo sapiens
LRSSSRRGSSPSWRNVIIRLGLGRQPSASPPRANRLRGPRGLLSSSQAAGPWRQAEAGPGPVPHPTSGSGPPTSPQGALPTTTFPVTQMTTFNTKWGGGRRPSSARGTCCELPGSPGCAHCSPVS

SEQ ID NO: 753599 - protein, 277 aa, Homo sapiens
MLNSTGELEFSNEEDPEIISQLTSLPLSGGKSSAGVPEKTGYPDSVYVMAANIFQGIRIEKSAQKVLIKYGNEPLRSLSESEDQSFQRLSYELAFSALKYQDILETILIDSCIFPSTTIPDHLSSLIIVMLYDFQDRKFQTRVLSDNEEPISEVQEVENLLNSFKIKLAAALARCRIKHDALSIYHILPETVRKQELRASTLPLYAWINTCKISPEEVYNNLKRRGYNKVKSVLHIDDKVFAVDQHCYDVLIFPSHLKNDLINIDLFKDYKLIFQVN

SEQ ID NO: 753600 - protein, 175 aa, Homo sapiens
MLNSTGELEFSNEEDPEIISQLTSLPLSGGKSSAGVPEKTGYPDSVYVMAANIFQGIRIEKSAQKVLIKYGNEPLRSLSESEDQSFQRLSYELAFSALKYQDILETILIDSCIFPSTTIPDHLSSLIIVMLYDFQDRKFQTRVLSDNEEPISEVQEVENLLNSISPHLLTCCLLS

SEQ ID NO: 753601 - protein, 191 aa, Homo sapiens
MLNSTGELEFSNEEDPEIISQLTSLPLSGGKSSAGVPEKTGYPDSVYVMAANIFQGIRIEKSAQKVLIKYGNEPLRSLSESEDQSFQRLSYELAFSALKYQDILETILIDSCIFPSTTIPDHLSSLIIVMLYDFQDRKFQTRVLSDNEEPISEVQEVENLLNSKKALTKCQHLDFGLLSLQNCEKINFCSL

SEQ ID NO: 753602 - protein, 345 aa, Homo sapiens
RRRPGGSRGGRCGARSREAAAAQGVPSVSAPGRGGGAARGGGGWRRSALVPGPGSEARSPPTEMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 753603 - protein, 299 aa, Homo sapiens
MVIIIFLLPPYVFISEKMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 753604 - protein, 299 aa, Homo sapiens; identical to SEQ ID NO: 753603

SEQ ID NO: 753605 - protein, 299 aa, Homo sapiens; identical to SEQ ID NO: 753603

SEQ ID NO: 753606 - protein, 299 aa, Homo sapiens; identical to SEQ ID NO: 753603

SEQ ID NO: 753607 - protein, 283 aa, Homo sapiens
MCEELLVTMYFSGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 753608 - protein, 299 aa, Homo sapiens; identical to SEQ ID NO: 753603

SEQ ID NO: 753609 - protein, 138 aa, Homo sapiens
MPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 753610 - protein, 299 aa, Homo sapiens; identical to SEQ ID NO: 753603

SEQ ID NO: 753611 - protein, 299 aa, Homo sapiens; identical to SEQ ID NO: 753603

SEQ ID NO: 753612 - protein, 313 aa, Homo sapiens
MTGKATPPSLYSWRGVLFTCLPAARTRKRKEMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 753613 - protein, 287 aa, Homo sapiens
TTPRPMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 753614 - protein, 299 aa, Homo sapiens; identical to SEQ ID NO: 753603

SEQ ID NO: 753615 - protein, 299 aa, Homo sapiens; identical to SEQ ID NO: 753603

SEQ ID NO: 753616 - protein, 299 aa, Homo sapiens; identical to SEQ ID NO: 753603

SEQ ID NO: 753617 - protein, 299 aa, Homo sapiens; identical to SEQ ID NO: 753603

SEQ ID NO: 753618 - protein, 39 aa, Homo sapiens
MRQLRHRDPPEAIQGTCLTRVGLCTARPPLLAAAPSQLC

SEQ ID NO: 753619 - protein, 798 aa, Homo sapiens
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDFGTPRLKTEHNITVLVSDVNDNAPAFTQTSYTLFVRENNSPALHIGSVSATDRDSGTNAQVTYSLLPPQDPHLPLASLVSINADNGHLFALQSLDYEALQAFEFRVGAADRGSPALSSEALVRVLVLDANDNSPFVLYPLQNGSAPCTELVPRAAEPGYLVTKVVAVDGDSGQNAWLSYQLLKATEPGLFGVWAHNGEVRTARLLRERDAAKQRLVVLVKDNGEPPRSATATLHVLLVDGFSQPYLLLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFT

SEQ ID NO: 753620 - protein, 447 aa, Homo sapiens
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDRDPVPELPVRGVSDWRLRDK

SEQ ID NO: 753621 - protein, 471 aa, Homo sapiens
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDPRCLRSSSSRCSCSWRCGCAGGAGRPRWVAARCPRAPFQGRWWT

SEQ ID NO: 753622 - protein, 121 aa, Homo sapiens
TRSLSLSHCGGLGLSSLHVPAVIDDSQGQFHCPRAWSSCCSGVLFGVEEKHSSLRQKTTHTHTHTHTHTHIRTLHVGLVSPASQCPVSRPPSLWLNRRRWGCICSAPLSQRCRSLCPAQNR

SEQ ID NO: 753623 - protein, 283 aa, Homo sapiens
CWPLSPAAYIKAYLLENGICIAKKKTKVARKSLDPLYNQVLLFPESPQGKVLQVIVWGNYGRMERKQFMGVARVLLEELDLTTLAVGWYKLFPTSSMVDPATGPLLRQASQLSLESTVGPCGERSECWNGEGLPKMAWRPPSPDLGPQAQGHIEQEDGALPHSGEAERGDLPPLGPLLTPSLPPTPETSPLPTGLATLLTWPVLDLVDVAAVQRKERLRWQSRPLSLPKLSNFSPFLPPRKLAAQSHVQNPAGHLHGANYQQVSFLRHRVQAATPAPEMKGQL

SEQ ID NO: 753624 - protein, 105 aa, Homo sapiens
LLLSPYLPAPLAGPTTLLHTTRFLSFWGSSTGHQGSADSKQSADLQQLWGTSDRSYSPTMELNGWGLHSTYTHTHTHSYPKWSQTNNDSNSNSTTYWPSYLREVS

SEQ ID NO: 753625 - protein, 192 aa, Homo sapiens
NETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKK

SEQ ID NO: 753626 - protein, 102 aa, Homo sapiens
LLIISNHTRVQSSCFGMETYGYLQRESCFQGPHKTTWQTSQCYRGSLLPELPTWWRVASKMAASLSFSDLGFLAPRIPRNGILGHAVNVIALLEDVGHGREP

SEQ ID NO: 753627 - protein, 769 aa, Homo sapiens
LLIISNHTRVQSSCFGMETYGYLQRESCFQGPHELYFKNLSKRNKQIMEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 753628 - protein, 769 aa, Homo sapiens; identical to SEQ ID NO: 753627

SEQ ID NO: 753629 - protein, 663 aa, Homo sapiens
MIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 753630 - protein, 402 aa, Homo sapiens
DLLFFSFFPLRSCHGLLTHLDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 753631 - protein, 95 aa, Homo sapiens
HRQDIYLDLEWEDSQEDFLEERAPQLAFESQTDRVWQPGSSTGEQTRLRHIHSCHLLNIAKPCSKHLERMISSVHVATLEAGPFTVHTWQRKELI

SEQ ID NO: 753632 - protein, 40 aa, Homo sapiens
MSMAPHQRPISHPGSSQIYVSFTINHLYSPAALSHHRAVA

SEQ ID NO: 753633 - protein, 76 aa, Homo sapiens
QSTGPKNQPEALTLSSLSTCPQQQQPRPSQQATEPPLALPVPVPAIKLHPTATLCRQAFPDTKASSCNSSANCKAF

SEQ ID NO: 753634 - protein, 135 aa, Homo sapiens
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGYFSDEDDCE

SEQ ID NO: 753635 - protein, 1066 aa, Homo sapiens
MTSYRERSADLARFYTVTEPQRHPRGYTVYKVTARVVSRRNPEDVQEIIVWKRYSDFKKLHKELWQIHKNLFRHSELFPPFAKGIVFGRFDETVIEERRQCAEDLLQFSANIPALYNSKQLEDFFKGGIINDSSELIGPAEAHSDSLIDTFPECSTEGFSSDSDLVSLTVDVDSLAELDDGMASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQPPGSLSSRPLWNLRSPAEELKAFRVLGVIDKVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 753636 - protein, 1048 aa, Homo sapiens
MTSYRERSADLARFYTVTEPQRHPRGYTVYKVTARVVSRRNPEDVQEIIVWKRYSDFKKLHKELWQIHKKAICETVIEERRQCAEDLLQFSANIPALYNSKQLEDFFKGGIINDSSELIGPAEAHSDSLIDTFPECSTEGFSSDSDLVSLTVDVDSLAELDDGMASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQPPGSLSSRPLWNLRSPAEELKAFRVLGVIDKVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 753637 - protein, 1066 aa, Homo sapiens; identical to SEQ ID NO: 753635

SEQ ID NO: 753638 - protein, 108 aa, Homo sapiens
LAGLTLLISTATQVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 753639 - protein, 359 aa, Homo sapiens
MTSYRERSADLARFYTVTEPQRHPRGYTVYKVTARVVSRRNPEDVQEIIVWKRYSDFKKLHKELWQIHKKAICETVIEERRQCAEDLLQFSANIPALYNSKQLEDFFKGGIINDSSELIGPAEAHSDSLIDTFPECSTEGFSSDSDLVSLTVDVDSLAELDDGMASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQPPGSLSSRPLWNLRSPAEELKAFRVLGVIDKVILQCLFKSSVINRLHADILSLKLWILRI

SEQ ID NO: 753640 - protein, 227 aa, Homo sapiens
MLAKGKKAVMKFRNSIGNSQRMNSYQLPNINSYMMPIPPPLPPTGKITRENRSETWRRRRFRPTTAPNGLEPLLTKDSRRIHKTSLHSNAAITMIYLGKNVHLSSDNPDFRDEIKVYQQHCGGENLCVYKGKLLEKETFQFISKRHHGFPFSLTFFLNGMQVNRLSSCCEYKHRKGSRLGGKRGYFGFVCVERSSPCYKCIIAMGLDKKPSLPKSRKEKSTEKGEEL

SEQ ID NO: 753641 - protein, 404 aa, Homo sapiens
MSYSCGLPSLSCRTSCSSRPCVPPSCHGCTLPGACNIPANVSNCNWFCEGSFNGSEKETMQFLNDRLASYLEKVRQLERDNAELENLIRERSQQQEPLVCASYQSYFKTIEELQQKILCSKSENARLVVQIDNAKLASDDFRTKYETELSLRQLVESDINGLRRILDELTLCRSDLEAQVESLKEELLCLKQNHEQEVNTLRCQLGDRLNVEVDAAPTVDLNQVLNETRSQYEALVETNRREVEQWFATQTEELNKQVVSSSEQLQSYQAEIIELRRTVNALEIELQAQHNLRDSLENTLTESEARYSSQLSQVQRLITNVESQLAEIRSDLERQNQEYQVLLDVRARLECEINTYRSLLESEDCKLPSNPCATTNACDKSTGPCISNPCGLRARCGPCNTFGY

SEQ ID NO: 753642 - protein, 101 aa, Homo sapiens
RLESNGAILAHCSLRLPGLSDSHASASCVAGITDVRHHAQLIFVFLLETGFHHVSQADLELLASCDPSTLASQSAAIIGVSHRTQPEFLFISHSFFSDIRN

SEQ ID NO: 753643 - protein, 461 aa, Homo sapiens
MLELRHRGSCPGPREAVSPPHREGEAAGGDHETESTSDKETDIDDRYGDLDSRTDSDIPEIPPSSDRTPEILKKALSGLSSRWKNWWIRGILTLTMISLFFLIIYMGSFMLMLLVLGIQVKCFHEIITIGYRVYHSYDLPWFRTLSWYFLLCVNYFFYGETVADYFATFVQREEQLQFLIRYHRFISFALYLAGFCMFVLSLVKKHYRLQFYMFAWTHVTLLITVTQSHLVIQNLFEGMIWFLVPISSVICNDITAYLFGFFFGRTPLIKLSPKKTWEGFIGGFFSTVVFGFIAAYVLSKYQYFVCPVEYRSDVNSFVTECEPSELFQLQTYSLPPFLKAVLRQERVSLYPFQIHSIALSTFASLIGPFGGFFASGFKRAFKIKDFANTIPGHGGIMDRFDCQYLMATFVHVYITSFIRGPNPSKVLQQLLVLQPEQQLNIYKTLKTHLIEKGILQPTLKV

SEQ ID NO: 753644 - protein, 224 aa, Homo sapiens
MLELRHRGSCPGPREAVSPPHREGEAAGGDHETESTSDKETDIDDRYGDLDSRTDSDIPEIPPSSDRTPEILKKALSGLSSRWKNWWIRGILTLTMISLFFLIIYMGSFMLMLLVLGIQVKCFHEIITIGYRVYHSYDLPWFRTLSWYFLLCVNYFFYGETVADYFATFVQREEQLQFLIRYHRFISFALYLAGFCMFVLSLVKKHYRLQFYMVPCSNIKCYLQ

SEQ ID NO: 753645 - protein, 461 aa, Homo sapiens; identical to SEQ ID NO: 753643

SEQ ID NO: 753646 - protein, 366 aa, Homo sapiens [sequence omitted]

SEQ ID NO: 753647 - protein, 461 aa, Homo sapiens; identical to SEQ ID NO: 753643

SEQ ID NO: 753648 - protein, 66 aa, Homo sapiens
GRRAGHLQNGINERALEAACSERGSGGGPGQAPGARREQRRRRRGLRLPGARLHAEAQVGGGEGKD

SEQ ID NO: 753649 - protein, 461 aa, Homo sapiens; identical to SEQ ID NO: 753643

SEQ ID NO: 753650 - protein, 461 aa, Homo sapiens; identical to SEQ ID NO: 753643

SEQ ID NO: 753651 - protein, 398 aa, Homo sapiens
MTDMEIWIPEQILIFRKFHHPQIEPLRFSKKLYLVYLQVIIYMGSFMLMLLVLGIQVKCFHEIITIGYRVYHSYDLPWFRTLSWYFLLCVNYFFYGETVADYFATFVQREEQLQFLIRYHRFISFALYLAGFCMFVLSLVKKHYRLQFYMFAWTHVTLLITVTQSHLVIQNLFEGMIWFLVPISSVICNDITAYLFGFFFGRTPLIKLSPKKTWEGFIGGFFSTVVFGFIAAYVLSKYQYFVCPVEYRSDVNSFVTECEPSELFQLQTYSLPPFLKAVLRQERVSLYPFQIHSIALSTFASLIGPFGGFFASGFKRAFKIKDFANTIPGHGGIMDRFDCQYLMATFVHVYITSFIRGPNPSKVLQQLLVLQPEQQLNIYKTLKTHLIEKGILQPTLKV

SEQ ID NO: 753652 - protein, 461 aa, Homo sapiens; identical to SEQ ID NO: 753643

SEQ ID NO: 753653 - protein, 334 aa, Homo sapiens
IARYEAGLRQIQKKNRNKCQYCRFHKCLSVGMSHNAIRFGRMPRSEKAKLKAEILTCEHDIEDSETADLKSLAKRIYEAYLKNFNMNKVKARVILSGKASNNPPFVIHDMETLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAAIICCGDRPGLLNVGHIEKMQEGIVHVLRLHLQSNHPDDIFLFPKLLQKMADLRQLVTEHAQLVQIIKKTESDAALHPLLQEIYRDMY

SEQ ID NO: 753654 - protein, 468 aa, Homo sapiens
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPPFVIHDMETLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAAIICCGDRPGLLNVGHIEKMQEGIVHVLRLHLQSNHPDDIFLFPKLLQKMADLRQLVTEHAQLVQIIKKTESDAALHPLLQEIYRDMY

SEQ ID NO: 753655 - protein, 258 aa, Homo sapiens
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPVGVCGCSGFSWQHGTSVVEDD

SEQ ID NO: 753656 - protein, 74 aa, Homo sapiens
LSPRREGPRAGTSGLALSSAQRSWGVADSEGAFRDLQGSPRRGNPGPGQTDPGLKLRALSALWTQQFVARQAQN

SEQ ID NO: 753657 - protein, 468 aa, Homo sapiens; identical to SEQ ID NO: 753654

SEQ ID NO: 753658 - protein, 468 aa, Homo sapiens; identical to SEQ ID NO: 753654

SEQ ID NO: 753659 - protein, 105 aa, Homo sapiens
VVPSEGGPTGGDIGTCPFLGAAELGRRRLRRCFPRPPGISEARKPGPRTDRPWAEAQGPVCSVDSTVCGKTSSELRSCHHSPLAAACQAWRPLFSSLNCCFLIRK

SEQ ID NO: 753660 - protein, 225 aa, Homo sapiens
METLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAAIICCGDRPGLLNVGHIEKMQEGIVHVLRLHLQSNHPDDIFLFPKLLQKMADLRQLVTEHAQLVQIIKKTESDAALHPLLQEIYRDMY

SEQ ID NO: 753661 - protein, 132 aa, Homo sapiens
MNRVKKGSFTCIDNSYTMDCFRDIRAIQGPSVDLLRSPLRRAITMCSHKVHLLPARKDQILSCISHWSHPIPVPPCYHLQCPPLLGTDPVGPLAYSTLFPTREGKIPEGGALQSEVKMAASLRATSAWAWYS

SEQ ID NO: 753662 - protein, 151 aa, Homo sapiens
MVIKKRLDVSKNGLGVPPSVHEKVEFPLGGELQRRLADQAELGPHCVTQAGVQWCNHSSLQPRLRRLKHISHLSFPSIWDHRDMDEAGNHHPQQTNTGTENQTPHVLTRKWELNNENTWTQGGEHHTPGPVREWGARGGRALGQTPNAYGA

SEQ ID NO: 753663 - protein, 111 aa, Homo sapiens
MHLASASGAVNAVALVAMRSEWTRMVLPPRSLGLPALRCPAAETDLIPQGLAQLPLPPHIPKYTYPSPTQSSSPDCGSRMTGQSWTHLCLPGQLTVGAGPKRPLDLDQLPV

SEQ ID NO: 753664 - protein, 84 aa, Homo sapiens
PSHSPLRGLHLRSLPLVHSLDRAPCVHRALPEARKWGRRAASPGVVLAVGVERGKAQLPGREPGAAVDLILRSQRRDAESRGLF

SEQ ID NO: 753665 - protein, 245 aa, Homo sapiens [sequence omitted]

SEQ ID NO: 753666 - protein, 418 aa, Homo sapiens
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRSFGNALGNCILDKDYLRSLNKLPRQLPLEVDLTKAKRQDLEPSVEEARYNSCRPNMALGHPQLQQVTSPSRPSHAVIPADQDCSSRSLSSSAVESEATHQRKLRQKQLQQQFRERMEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 753667 - protein, 418 aa, Homo sapiens; identical to SEQ ID NO: 753666

SEQ ID NO: 753668 - protein, 418 aa, Homo sapiens; identical to SEQ ID NO: 753666

SEQ ID NO: 753669 - protein, 468 aa, Homo sapiens
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRLPLLGVSGRILYSLFSVHSVMCAGGLPTPTASAQTAPSSPCSSAVLRYAQSFGNALGNCILDKDYLRSLNKLPRQLPLEVDLTKAKRQDLEPSVEEARYNSCRPNMALGHPQLQQVTSPSRPSHAVIPADQDCSSRSLSSSAVESEATHQRKLRQKQLQQQFRERMEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 753670 - protein, 131 aa, Homo sapiens
LHSGLQSQPAVRVLPAAAAVAQEPVLAAALSCRSLSSSAVESEATHQRKLRQKQLQQQFRERMEKQQVRVSTPSAEKSEAAPPAPPVTHSTPVTVSEPLLEKDFLAGVTQELISKYLEMLRLLKTTLKSGL

SEQ ID NO: 753671 - protein, 147 aa, Homo sapiens
MEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 753672 - protein, 98 aa, Homo sapiens
RGGRGPPGAFRGTRDRHALGSLQFLGLLSSPPSVLPTYDYQLLDDVLLPDQPFISWTSGYLPRKSHPLTIFHDLSHLTRDLPILLLPSSVVSEFLFLP

SEQ ID NO: 753673 - protein, 418 aa, Homo sapiens; identical to SEQ ID NO: 753666

SEQ ID NO: 753674 - protein, 139 aa, Homo sapiens
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKVRGWSRPAARKDQWVVGEGWFIS

SEQ ID NO: 753675 - protein, 207 aa, Homo sapiens
MALGHPQLQQVTSPSRPSHAVIPADQDCSSRSLSSSAVESEATHQRKLRQKQLQQQFRERMEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 753676 - protein, 105 aa, Homo sapiens [sequence omitted]

SEQ ID NO: 753677 - protein, 237 aa, Homo sapiens
NALEKAVVLWGGGKSNCFPDLQLGWMLRCPVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREK

SEQ ID NO: 753678 - protein, 116 aa, Homo sapiens
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 753679 - protein, 116 aa, Homo sapiens; identical to SEQ ID NO: 753678

SEQ ID NO: 753680 - protein, 92 aa, Homo sapiens
QIFSIVLPTSLSLFFYPFCPIQELAKYFLAELLSEPNQTENDALEPEDLSQAAEQDEMRLELQRSANSNPAMAPRERKAGCKNFFWKTFTSC

SEQ ID NO: 753681 - protein, 86 aa, Homo sapiens
HHSPPPDLPSYTRPPSELAKYFLAELLSEPNQTENDALEPEDLSQAAEQDEMRLELQRSANSNPAMAPRERKAGCKNFFWKTFTSC

SEQ ID NO: 753682 - protein, 35 aa, Homo sapiens
MVKQFYFVARDVKIELNCWHTLYLTRTVFMCVCVC

SEQ ID NO: 753683 - protein, 72 aa, Homo sapiens
ATEIFQVPRAAEQGRNEGLSCRDLLTSNPAMAPRERKAGLELQRSANSNPAMAPRERKAGCKNFFWKTFTSC

SEQ ID NO: 753684 - protein, 49 aa, Homo sapiens
MNVTSDKAYVATWLLMVEKKREVNYHNVGIFSIIFAFSFLSEVHFSKGM

SEQ ID NO: 753685 - protein, 122 aa, Homo sapiens
KPQEIAWRGSADSGHGLNVKSVNFGLCTFSALSGEVCYVSDSVQEMGDMSLGFLHLAPLGPPTPAISSDHRPYPRLLHLTLLWCTFPTAAFARGQLFPGGCFQIFTTGCLWLLWAPEWDRVF

SEQ ID NO: 753686 - protein, 691 aa, Homo sapiens
MPDALSCVGTLGLLTLSPGDRPHRRPRPAAALPGVCPEAVGQRPEPGALGFHLHPPTHRQTPGPQLTPGPCPGCPRASSGLPGALPVPHTRAQSRRRPPRTPVCGCTGPGPRARVPGFPGFLPTEPSLDSCACSQGGREGPPGGAEVTRGQEVHDPQRLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAARLFSSLGELSSISAQRSPGGPGGGASYSVRPSGRYPVARRAPSPVKPASLERVEGLGAGAGGAGRPFGLTPPTILKSSSLSIPHEPKEVRFVVRSVSARSRSPSPSPLPSPASGPGPGAPGPRRPFQQKPLQLWSKFDVGDWLESIHLGEHRDRFEDHEIEGAHLPALTKDDFVELGVTRVGHRMNIERALRQLDGS

SEQ ID NO: 753687 - protein, 611 aa, Homo sapiens
PGPDSPYANLGAFSASLFAPSKPQRRKSPLVKQLQVEDAQERAALAVGSPGPGGGSFAREPSPTHRGPRPGGLDYGAGDGPGLAFGGPGPAKDRRLEERRRSTVFLSVGAIEGSAPGADLPSLQPSRSIDERLLGTGPTAGRDLLLPSPVSALKPLVSGPSLGPSGSTFIHPLTGKPLDPSSPLALALAARERALASQAPSRSPTPVHSPDADRPGPLFVDVQARDPERGSLASPAFSPRSPAWIPVPARREAEKVPREERKSPEDKKSMILSVLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAAR

SEQ ID NO: 753688 - protein, 807 aa, Homo sapiens
PGPDSPYANLGAFSASLFAPSKPQRRKSPLVKQLQVEDAQERAALAVGSPGPGGGSFAREPSPTHRGPRPGGLDYGAGDGPGLAFGGPGPAKDRRLEERRRSTVFLSVGAIEGSAPGADLPSLQPSRSIDERLLGTGPTAGRDLLLPSPVSALKPLVSGPSLGPSGSTFIHPLTGKPLDPSSPLALALAARERALASQAPSRSPTPVHSPDADRPGPLFVDVQARDPERGSLASPAFSPRSPAWIPVPARREAEKVPREERKSPEDKKSMILSVLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAARLFSSLGELSSISAQRSPGGPGGGASYSVRPSGRYPVARRAPSPVKPASLERVEGLGAGAGGAGRPFGLTPPTILKSSSLSIPHEPKEVRFVVRSVSARSRSPSPSPLPSPASGPGPGAPGPRRPFQQKPLQLWSKFDVGDWLESIHLGEHRDRFEDHEIEGAHLPALTKDDFVELGVTRVGHRMNIERALRQLDGS

SEQ ID NO: 753689 - protein, 611 aa, Homo sapiens; identical to SEQ ID NO: 753687

SEQ ID NO: 753690 - protein, 202 aa, Homo sapiens
MCTGGCARCLGGTLIPLAFFGFLANILLFFPGGKVIDDNDHLSQEIWFFGGILGSGVLMIFPALVFLGLKNNDCCGCCGNEGCGKRFAMFTSTIFAVVGFLGAGYSFIISAISINKGPKCLMANSTWGYPFHDGDYLNDEALWNKCREPLNVVPWNLTLFSILLVVGGIQMVLCAIQVVNGLLGTLCGDCQCCGCCGGDGPV

SEQ ID NO: 753691 - protein, 202 aa, Homo sapiens; identical to SEQ ID NO: 753690

SEQ ID NO: 753692 - protein, 72 aa, Homo sapiens
AWRGHTLMFEALWNKCREPLNVVPWNLTLFSILLVVGGIQMVLCAIQVVNGLLGTLCGDCQCCGCCGGDGPV

SEQ ID NO: 753693 - protein, 70 aa, Homo sapiens
CPGLHPIRALWNKCREPLNVVPWNLTLFSILLVVGGIQMVLCAIQVVNGLLGTLCGDCQCCGCCGGDGPV

SEQ ID NO: 753694 - protein, 69 aa, Homo sapiens
RVIAHAVALWNKCREPLNVVPWNLTLFSILLVVGGIQMVLCAIQVVNGLLGTLCGDCQCCGCCGGDGPV

SEQ ID NO: 753695 - protein, 88 aa, Homo sapiens
AWRGHTLMFEALWNKCREPLNVVPWNLTLFSILLVVGGIQMVLCAIQVVNGLLGTLCGDCQCCGCCGFIKLLLFLELLIPICFLADKA

SEQ ID NO: 753696 - protein, 202 aa, Homo sapiens; identical to SEQ ID NO: 753690

SEQ ID NO: 753697 - protein, 202 aa, Homo sapiens; identical to SEQ ID NO: 753690

SEQ ID NO: 753698 - protein, 74 aa, Homo sapiens
VLLLGNPLPESEALWNKCREPLNVVPWNLTLFSILLVVGGIQMVLCAIQVVNGLLGTLCGDCQCCGCCGGDGPV

SEQ ID NO: 753699 - protein, 202 aa, Homo sapiens; identical to SEQ ID NO: 753690

SEQ ID NO: 753700 - protein, 202 aa, Homo sapiens; identical to SEQ ID NO: 753690

SEQ ID NO: 753701 - protein, 102 aa, Homo sapiens
TDSKKIWLFPKFPDDNNIQVALGSNWSRKGMWRGEEMKPEVWLFLRSTKEHSQSFRYIEMRWESEEDLRCKMCTTRKLFNTSSLSREFKSSLLVSESTCLIL

SEQ ID NO: 753702 - protein, 153 aa, Homo sapiens
MGLLTFRDVAIEFSLEEWQCLDTAQRNLYKNVILENYRNLVFLGIAVSKQDLITCLEQEKEPLTVKRHEMVNEPPVMCSHFAQEFWPEQNIKDSFEKVTLRRYEKCGNDNFQLKGCKSVDECKVHKGGYNGLNQCLPTMQSKMFQCDKYVKVS

SEQ ID NO: 753703 - protein, 108 aa, Homo sapiens
MGLLTFRDVAIEFSLEEWQCLDTAQRNLYKNVILENYRNLVFLGIAVSKQDLITCLEQEKEPLTVKRHEMVNEPPESRPVVQPEVQWYNLCLLQPPPPRFKDSPVSPS

SEQ ID NO: 753704 - protein, 102 aa, Homo sapiens
MGLLTFRDVAIEFSLEEWQCLDTAQRNLYKNVILENYRNLVFLGIAVSKQDLITCLEQEKEPLTVKRHEMVNEPPDLWEQTQQVVPHVRSNEMHHDGTLKNE

SEQ ID NO: 753705 - protein, 34 aa, Homo sapiens
QWTLLEFPASRMEFWAFLKASCCITTSSQNCPDQ

SEQ ID NO: 753706 - protein, 83 aa, Homo sapiens
HGAKSSGSLAGKTKVHAAQQMIVEHLSEPKSLGECGDFLEGGCRLPESPPNGRAEKGEGGGGCSQEGAREEQGLGASRNMPAV

SEQ ID NO: 753707 - protein, 178 aa, Homo sapiens
MHSLKKLTFEDVAIDFTQEEWAMMDTSKRKLYRDVMLENISHLVSLGYQISKAYIILQLEQGKELWREGRVFLQDQNPNRESALKKTHMISMHPITRKDASTSMTMENSLILEDPFECNDSGEDCTRSSTITQCLLTHSGKKPYVSKQCGKSLRNLLSTEPHKQIHTKGNPTSNWMSG

SEQ ID NO: 753708 - protein, 178 aa, Homo sapiens; identical to SEQ ID NO: 753707

SEQ ID NO: 753709 - protein, 330 aa, Homo sapiens
MHSLKKLTFEDVAIDFTQEEWAMMDTSKRKLYRDVMLENISHLVSLGYQISKAYIILQLEQGKELWREGRVFLQDQNPNRESALKKTHMISMHPITRKDASTSMTMENSLILEDPFECNDSGEDCTRSSTITQCLLTHSGKKPYVSKQCGKSLRNLLSTEPHKQIHTKGNPLPTGCLDELLKAAECPAAGHFQSSGRPSRRDDGGRVLTYYVKLLFGVGHECMCPCATTGILTTTQMNPLKCWQVEQSPRTVCNLYRYRNTPSSRIFTPGFRPTPATTPGTNLIFYYFADISSANTRQIETMTFHRTQITSYCRKEDPVRKLVHKWNVNP

SEQ ID NO: 753710 - protein, 178 aa, Homo sapiens; identical to SEQ ID NO: 753707

SEQ ID NO: 753711 - protein, 178 aa, Homo sapiens; identical to SEQ ID NO: 753707

SEQ ID NO: 753712 - protein, 156 aa, Homo sapiens [sequence omitted]

SEQ ID NO: 753713 - protein, 139 aa, Homo sapiens
MAVTITLKTLQQQVIQRAEEDAASTLVTGSEYETMLTEIMSMGYERERVVAALRASYNNPHRAVEYLLTGIPGSPEPEHGSVQESQVSEQPATEAAGENPLEFLPALLQQPWAQENPQLLQQISRQEQFIQMLNEPPGK

SEQ ID NO: 753714 - protein, 201 aa, Homo sapiens
GTPILTTRLGLCCGGAEAPPADLLLTWAGASSQPICTAGLRSPPQGPLALICHCRRDACPCSPHLRHVPSPTCRQRGQEPIRGIRPTTSPESVSGSVPSSGSSGREEDAASTLVTGSEYETMLTEIMSMGYERERVVAALRASYNNPHRAVEYLLTGIPGSPEPEHGSVQESQVSEQPATEAGENPWSSCGTSPSSRTCGR

SEQ ID NO: 753715 - protein, 115 aa, Homo sapiens
MQAQAPVVVVTQPGVGPGPAPQNSNWQTGMCDCFSDCGVCLCGTFCFPCLGCQVAADMNECCLCGTSVAMRTLYRTRYGIPGSICDDYMATLCCPHCTLCQIKRDINRRRAMRTF

SEQ ID NO: 753716 - protein, 115 aa, Homo sapiens; identical to SEQ ID NO: 753715

SEQ ID NO: 753717 - protein, 182 aa, Homo sapiens
MYYEAKRRDTNCKRNEINQTTEQPDRHIKNKTHEMKQNNPYARTTKREANKHTPQPRERDTLQRTTHTEKEKPTKRKQTQHRRDNEEEQKATRHKRRRQEKKKRNERTTRAKQRKYYTQGRTKKTSRASVQPKTNQKQTKLQPTHDTTSAPPTPQPSNPTAPAHSPTTLTQPHHTQRHTADP

SEQ ID NO: 753718 - protein, 115 aa, Homo sapiens; identical to SEQ ID NO: 753715

SEQ ID NO: 753719 - protein, 115 aa, Homo sapiens; identical to SEQ ID NO: 753715

SEQ ID NO: 753720 - protein, 115 aa, Homo sapiens; identical to SEQ ID NO: 753715

SEQ ID NO: 753721 - protein, 231 aa, Homo sapiens
QLPAAGAAERKARPLRVRFGPAPPAPPAPATGTWYGRAVGVLCGSCQGRAFQIFPLKEWRRPGQFALEMEGPSLRGPALRLAGLPTQQDCNIQEKIDLEIRMREGIWKLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIL

SEQ ID NO: 753722 - protein, 157 aa, Homo sapiens
QLPAAGAAERKARPLRVRFGPAPPAPPAPATGTWYGRAVGVLCGSCQGRAFQIFPLKEWRRPGQFALEMEGPSLRGPALRLAGLPTQQDCNIQEKIDLEIRMREGIWKLLSLSTQKDQVLHAVKNLMVCNARLMAYTSELQKLEEQIANQTGRWLVT

SEQ ID NO: 753723 - protein, 189 aa, Homo sapiens
SPHAPRLPERKYLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIFNEAGPDFQIKVEVYSCCTEESSITNTPKKLAKKLKTSISKATGKKHKFSASRRG

SEQ ID NO: 753724 - protein, 90 aa, Homo sapiens
RKMTLGLSSHFPCCHLPVLWKPSLDVHCLAGTFLFSSPVTTQVFDSLPPARGPASSLPEDQASEELHMGGNTNRLTSSETTSNPAHHHAS

SEQ ID NO: 753725 - protein, 105 aa, Homo sapiens
LSLKEQKPKKSEKLTTKRRSVFSSPPWISWVGARSSQGPCKRKARGQSRAEEAKVRGEERLLTLKMEERPEPRGAADPRNGKRDTDPPLAPPGGVEPSQHLDRSF

SEQ ID NO: 753726 - protein, 261 aa, Homo sapiens
PTTTPDPTTTPHPTTPDPSSTPVITTVSLPTSLGTELSSPTLAPTVKPSLHPQLTFTAPAPHTSTSQIPTLEPSPALESSPSRSSTATSMDPLSTEDFKPPRSQSPNLTPPPTHTPHSASDLTVSPDPLLSPTAHPLDHPPLDPLTLGPTPGQSPGPHGPCVAPTPPVRVMACEPPALVELVAAVRDVGGQLQRLTQVVEQERQERQALLLGLTQLVEAARGLGQLGEAVKRLAEMAWTTSMPAPTTTTPEEEERPLRGDV

SEQ ID NO: 753727 - protein, 536 aa, Homo sapiens
MGPLQFRDVAIEFSLEEWHCLDTAQRNLYRNVMLENYSNLVFLGIVVSKPDLIAHLEQGKKPLTMKRHEMVANPSVICSHFAQDLWPEQNIKDSFQKVILRRYEKRGHGNLQLIKRCESVDECKVHTGGYNGLNQCSTTTQSKVFQCDKYGKVFHKFSNSNRHNIRHTEKKPFKCIECGKAFNQFSTLITHKKIHTGEKPYICEECGKAFKYSSALNTHKRIHTGEKPYKCDKCDKAFIASSTLSKHEIIHTGKKPYKCEECGKAFNQSSTLTKHKKIHTGEKPYKCEECGKAFNQSSTLTKHKKIHTGEKPYVCEECGKAFKYSRILTTHKRIHTEEKPYKCNKCGKAFIASSTLSRHEFIHMGKKHYKCEECGKAFIWSSVLTRHKRVHTGEKPYKCEECGKAFKYSSTLSSHKRSHTGEKPYKCEECGKAFVASSTLSKHEIIHTGKKPYKCEECGKAFNQSSSLTKHKKIHTGEKPYKCEECGKAFNQSSSLTKHKKIHSGEKPYECDKCGKAFISPSSLSRHEIIHTGEKP

SEQ ID NO: 753728 - protein, 123 aa, Homo sapiens
MGPLQFRDVAIEFSLEEWHCLDTAQRNLYRNVMLENYSNLVFLGIVVSKPDLIAHLEQGKKPLTMKRHEMVANPSGARLLSQHFGRPRWVDPEVRRSRPSGQHGEIPSLLKYKKLARHGGPCL

SEQ ID NO: 753729 - protein, 106 aa, Homo sapiens
MMTLVPRARTRAGQDHYSHPCPRFSQVLLTEGIMTYCLTKNLSDVNILHRLLKNGNVRNTLLQSKVGLLTYYVKLYPGEVTLLTRPSIQMRLCCITGSVSKPRSQK

SEQ ID NO: 753730 - protein, 321 aa, Homo sapiens
MFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 753731 - protein, 359 aa, Homo sapiens
GRVGKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 753732 - protein, 321 aa, Homo sapiens; identical to SEQ ID NO: 753730

SEQ ID NO: 753733 - protein, 37 aa, Homo sapiens
MIAGTGMLSRVALRTGALSHQILDRASSDRGAGYDYM

SEQ ID NO: 753734 - protein, 102 aa, Homo sapiens
MTGGCLSKRLPGVITEVVTEPPRPEPVTPEGWCTFTMPSVEGPHLPCLRVSFCSVRFSIEAIGGRRLLCLICPKSLLAISPMQQALVPTTISPGKRFEGLEL

SEQ ID NO: 753735 - protein, 94 aa, Homo sapiens
VSAGTTPAQGALCPADPLPEAGELGEAALCHPPRALTGRPSSLSGTVSAAVRFGAGRLWLALAHRGWSCRFCCGHAGFPRQTRRWDRDPFLEAE

SEQ ID NO: 753736 - protein, 146 aa, Homo sapiens
SCRVRTLAFLFRLWTKCLFIMPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 753737 - protein, 155 aa, Homo sapiens
ICFFSVQSLLSVDDDTDNPDDSVFYQVQSLFGHLMESKLQYYVPENFWKIFKMWNKELYVREQQDAYEFFTSLIDQMDEYLKKMGRDQIFKNTFQGIYSDQKICKDCPHRYEREEAFMALNLGVTSCQSLEISLDQFVRGEVLEGSNAYYCEKCK

SEQ ID NO: 753738 - protein, 79 aa, Homo sapiens
SSPVSSDSNTVTHSVIPASVCGVVLLVSFLPGLPSLTSEKCKNPMGVTPSVPLQLAPSPAPPTLLTFSHLDNLSCILNG

SEQ ID NO: 753739 - protein, 38 aa, Homo sapiens
LPGSSLLAHNWVGPVTNDKHELDPGDIQSPHNKAPVGA

SEQ ID NO: 753740 - protein, 109 aa, Homo sapiens
MAKLVLRPRQSGPNAHAGNCWGSQSSVPLSPQNWNLTNSLPLGRASPAPTGLPHLHLDWHIWTGPSHSPQNSPDKCTGACEYIYACARICVRLCARVGGCLLSRSNRQP

SEQ ID NO: 753741 - protein, 109 aa, Homo sapiens; identical to SEQ ID NO: 753740

SEQ ID NO: 753742 - protein, 162 aa, Homo sapiens
GRRRSGTPGQATAVHSSALRLWEIRAQCRSFRAWVALGPPAAFPGGVPTLLRSWFRDACRGGHSPQPATVLRPSLLGVSFWGFLGAARVDSSRLPNSAPLATGSLQPCTLGALIVDYSWSPGATGPCLAWQESADWTQGSEPREPSSRSGRTHRGSQQLRTV

SEQ ID NO: 753743 - protein, 116 aa, Homo sapiens
MGAVDKLAPVPQIDPTIQSFERLRCILVLKIKILKQHPHRVREKNKRLEKKAPHLLKAGPGAPPSPAMLRLAKGPGQLQVPGPLVGRGQAQPFCFNSRQQQGTHTPTPSWRRAPSG

SEQ ID NO: 753744 - protein, 198 aa, Homo sapiens
THITIRKQKERGANLHRLSYLPPLHAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRGK

SEQ ID NO: 753745 - protein, 205 aa, Homo sapiens
MSRKNIFQESSPLQNFFSLLNIRNIGVSHRARQPQALQGPPSSNDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKGLSSHKPEAAGFHRLGIILYQPLPKGENQRIESMRPFEALLRVRI

SEQ ID NO: 753746 - protein, 193 aa, Homo sapiens [sequence omitted]

SEQ ID NO: 753747 - protein, 183 aa, Homo sapiens
SGVGPMEGSPAGPIEQKEARWESSWEEQPDWTLGCLSPESHTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 753748 - protein, 239 aa, Homo sapiens
MSRKNIFQESSPLQNFFSLLNIRNIGVSHRARQPQALQGPPSSNDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 753749 - protein, 218 aa, Homo sapiens
MSRKNIFQESSPLQNFFSLLNIRNIGVSHRARQPQALQGPPSSNDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRGK

SEQ ID NO: 753750 - protein, 239 aa, Homo sapiens; identical to SEQ ID NO: 753748

SEQ ID NO: 753751 - protein, 271 aa, Homo sapiens
SGVGPMEGSPAGPIEQKEARWESSWEEQPDWTLGCLSPESQFRIPGLPGCILSFQLKVCFLPVMWLFILLSLALISDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 753752 - protein, 219 aa, Homo sapiens
THITIRKQKERGANLHRLSYLPPLHAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 753753 - protein, 239 aa, Homo sapiens; identical to SEQ ID NO: 753748

SEQ ID NO: 753754 - protein, 81 aa, Homo sapiens
MSCLTKEDTGWYWCGIQRDFARDDMDFTELIVTDDKGTLANDFWSGKDLSGNKTRAARLQVSQLTSGRPSHHSILITVPHS

SEQ ID NO: 753755 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 753756 - protein, 257 aa, Homo sapiens; identical to SEQ ID NO: 753755

SEQ ID NO: 753757 - protein, 257 aa, Homo sapiens; identical to SEQ ID NO: 753755

SEQ ID NO: 753758 - protein, 212 aa, Homo sapiens
MSELRSSRTEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 753759 - protein, 257 aa, Homo sapiens; identical to SEQ ID NO: 753755

SEQ ID NO: 753760 - protein, 257 aa, Homo sapiens; identical to SEQ ID NO: 753755

SEQ ID NO: 753761 - protein, 99 aa, Homo sapiens
SLLMTLTYKENIMKSSRIHHDQPVKPLDRAVFWIEFVMRHKGAKHLRVAAHDLTWFQYHSLDVIGFLLACVATVLFIITKCCLFCFWKFARKGKKGKRD

SEQ ID NO: 753762 - protein, 134 aa, Homo sapiens
KDTHIHIPYESCGHHDTSILNIYTLVFLSFFETESHSVTHAGVQWYDLGSLKPPPPGFKRFSCLSLLSSWNECLLLRTFSYIAPVPSPHLRKLKIILYYPISRPYSNFPSCPKIVVDSVFQTGIHSRSSCCPVC

SEQ ID NO: 753763 - protein, 82 aa, Homo sapiens
YFFQISHCTLPDYSPGGDSCSKTQDVSEEPAGTKAGRHQLYSCSSYASSLCCSYQKHKALAQTEKCDLTPRLDNFQTVSMTL

SEQ ID NO: 753764 - protein, 74 aa, Homo sapiens
MPLKTFPAAIRGVIQSELNYSVILQWVVTMDPEPVLSWTFSGVPCGMGEKLFIRRLSCEQLGTYMCIATNSKKQ

SEQ ID NO: 753765 - protein, 74 aa, Homo sapiens; identical to SEQ ID NO: 753764

SEQ ID NO: 753766 - protein, 668 aa, Homo sapiens
MDTRSGSQCSVTPEAILNNEKLVLPPRISRVNGWSLPLHYFQVVTWAVFVGLSSATFGIFIPFLPHAWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPGVLRTDPRYEDVKNMNTWLLFLPLFPVQVQTLIVVIIGMLVLLLDFLGLVHLGQLLIFHIYLKAKKMTTFEYLINNRKEESSKHQAVRKDPYVQMDKGVLQQGAGALGSSAQGVKAKSSLLIHKHLCHFCTSVNQDGDSTAREGDEDPCPSALGAKARNSRLICRRLCQFSTRVHPDGGSMAQEADDAPSISTLGLQQETTEPMKTDSAESEDWRFRSSGAPVIQVFYPETPPSIKVLPVESTLQSLLLLPMLQARNQSPSSQRPLDVLRRNQDPQSPASISVIIFITPKEEPALQEGLHLQEDGLPATAEDAATCLTVLSSQPASCRASCCLRADGPGMLAHTCEHSTGKWEHSTRKWEHSTGKWEHSTGKWGLTALQNGSTVLGNGSTVLGSGSTVLRSGSTVLRNGSTLLRNGSTVLGNGHTVLGNGHTVLRNGSTQYWEMGAHSTGKWEFTVLGKGSSQYSEMGA

SEQ ID NO: 753767 - protein, 360 aa, Homo sapiens
MDTRSGSQCSVTPEAILNNEKLVLPPRISRVNGWSLPLHYFQVVTWAVFVGLSSATFGIFIPFLPHAWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPGVLRTDPRYEDVKNMNTWLLFLPLFPVQVQTLIVVIIGMLVLLLDFLGLVHLGQLLIFHIYLKAKKMTTFEYLINNRKEESSKHQAVRKDPYVQMDKGVLQQGAGALGSSAQGVKAKSSLLIHKHLCHFCTSVNQDGDSTARGHLTTLPQDFREQAPVTWK

SEQ ID NO: 753768 - protein, 220 aa, Homo sapiens
MLQARNQSPSSQRPLDVLRRNQDPQSPASISVIIFITPKEEPALQEGLHLQEDGLPATAEDAATCLTVLSSQPASCRASCCLRADGPGMLAHTCEHSTGKWEHSTRKWEHSTGKWEHSTGKWGLTALQNGSTVLGNGSTVLGSGSTVLRSGSTVLRNGSTLLRNGSTVLGNGHTVLRNGSTQYWEMGAHSTGKWEFTVLGNGSTVLGNGSIVLGNPRPGF

SEQ ID NO: 753769 - protein, 360 aa, Homo sapiens; identical to SEQ ID NO: 753767

SEQ ID NO: 753770 - protein, 102 aa, Homo sapiens
MPVAFFSPSSKSPSPAASMLSGLSLWGMPGESERAEVAKMACAAFSPGTCCFHRAVPVSPCEFIDCGLSEFLGLLFQMILQGFKTSKALSKAAPSSHGLNSS

SEQ ID NO: 753771 - protein, 360 aa, Homo sapiens; identical to SEQ ID NO: 753767

SEQ ID NO: 753772 - protein, 76 aa, Homo sapiens
AAPVSRNSHKTSALTVLVFRERSMESLAPPWKLVAEIGAEPILLTFVKTALLDKRVYQVLLCFPGLLCCLQDRPGG

SEQ ID NO: 753773 - protein, 444 aa, Homo sapiens
PEARRNYNMYHPRELYPSLGAGYRLGPAQPGADSSFPPALAEGYRYPELDTPKLDCFLSGMEAAPRTLAAHPPLPLLPPAMGTEPAPSAPEALHSLPGVSLSLENRELWKEFSSVGTEMIITKAGRRMFPACRVSVTGLDPEARYLFLLDVIPVDGARYRWQGRRWEPSGKAEPRLPDRVYIHPDSPATGAHWMRQPVSFHRVKLTNSTLDPHGHLILHSMHKYQPRIHLVRAAQLCSQHWGGMASFRFPETTFISVTAYQNPQITQLKIAANPFAKGFRENGRNCKRERDARVKRKLRGPEPAATEAYGSGDTPGGPCDSTLGGDIRESDPEQAPAPGEATAAPAPLCGGPSAEAYLLHPAAFHGAPSHLPTRSPSFPEAPDSGRSAPYSAAFLDVPHGSGGSGYPAAPPAVPFAPHFLQGGPFPLPYTAPGGYLDVGSKPMY

SEQ ID NO: 753774 - protein, 229 aa, Homo sapiens
TQLHSPILKSQRPQARGEPPPPERGDQSLEAKLRDSSDSELLRDILQKTVRHPVCVKHPPSVKYAWCFLSELIKKSSGGSVTLSKSTAIISHGTTGLVTWDAALYLAEWAIENPAAFINRTVLELGSGAGLTGLAICKMCRPRAYIFSDPHSRILEQLRGNVLLNGLSLEADITGNLDSPRVTVAQLGLGREAMVHQLSAFQPDVVIAADVLYCPEAIVSLVGVCRGWC

SEQ ID NO: 753775 - protein, 99 aa, Homo sapiens
PEENAGTELLLQGFERRFLAVRTLRSFPWQSLEAKLRDSSDSELLRDILQKVFACLMTDGSTQTCQPLPRPHPEVAQLCMRTISNIPVIVPPTQQQEPA

SEQ ID NO: 753776 - protein, 510 aa, Homo sapiens
MRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGEGPSVGLERGPGSLPSRNRVGRPPQPSHPPSPILPEALNAMGAVYLRVLKQPRDPSLPCCPPGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 753777 - protein, 401 aa, Homo sapiens
MRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGEGPSVGLERGPGSLPSRNRVGRPPQPSHPPSPILPEALNAMGAVYLRVLKQPRDPSLPCCPPGHDTTASGLSWVLYHLAKHPEYQERCRQEVQELLKDREPKEIEWSTTPFALTQRTSRRGHLWLLFPSRQGPGTASGRRSRWRR

SEQ ID NO: 753778 - protein, 491 aa, Homo sapiens
MRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGEGPSVGLERGPGSLPSRNRVGRPPQPSHPPSPILPEALNAMGAVYLRVLKQPRDPSLPCCPPGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPESEFPPPSPRNCIGQTFAMAEMKVVLALTLLRFRVLPDHTEPRRKPELVLRAEGGLWLRVEPLS

SEQ ID NO: 753779 - protein, 538 aa, Homo sapiens
HQQTERGGCLGQTAPDRRMSQLSLSWLGLWPVAASPWLLLLLVGASWLLAHVLAWTYAFYDNCRRLRCFPQPPRRNWFWGHQGMVNPTEEGMRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 753780 - protein, 343 aa, Homo sapiens
AVRPGILGCACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 753781 - protein, 214 aa, Homo sapiens
MGAVYLRVLKQPRDPSLPCCPPGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 753782 - protein, 103 aa, Homo sapiens
VTLSATRSPLPLVQKSELSKPASIWLQPSNPGDQTPWGAINGPATGINSNPRTLSTAPTIRRAVQMAGTKDPPWQLKRAVTVGRGDQNTPSSLRSLPVPSLCS

SEQ ID NO: 753783 - protein, 110 aa, Homo sapiens
MTRHKKQGSNMLVSLPFPKLFEDSLGKTSPSAWHLVHDVGSYILARVISLPTFTCNPCIIFLWLQSFIYETHRNPSNSQRVESNSFLPKPIHGPLALDNISQASPLTHKV

SEQ ID NO: 753784 - protein, 172 aa, Homo sapiens
MFYHISLEHEILLHPRYFGPNLLNTVKQKLFTEVEGTCTGKYGFVIAVTTIDNIGAGVIQPGRGFVLYPVKYKAIVFRPFKGEVVDAVVTQVNKVGLFTEIGPMSCFISRHSIPSEMEFDPNSNPPCYKTMDEDIVIQQDDEIRLKIVGTRVDKNDIFAIGSLMDDYLGLVS

SEQ ID NO: 753785 - protein, 172 aa, Homo sapiens; identical to SEQ ID NO: 753784

SEQ ID NO: 753786 - protein, 87 aa, Homo sapiens
QPLLHQEWTDYRLSWDPAEHDGIDSLRITAESVWLPDVVLLNNNDGNFDVALDISVVVSSDGSVRWQPPGIYRSSCSIQVSGLHIGS

SEQ ID NO: 753787 - protein, 298 aa, Homo sapiens
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAERRWGSQIFVQLTQSSTSTIPRDPQ

SEQ ID NO: 753788 - protein, 429 aa, Homo sapiens
MSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 753789 - protein, 501 aa, Homo sapiens
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 753790 - protein, 77 aa, Homo sapiens
LTGSLAALVTLSSIQVTYFPFDWQNCTMVFSSYSYDSSEVSLQTGLGPDGQGHQEIHIHEGTFIENGQWEIITSLSG

SEQ ID NO: 753791 - protein, 359 aa, Homo sapiens
MSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 753792 - protein, 106 aa, Homo sapiens
RATGVSQEHLQPCPPCPDCGEHRARSTVHGRGWKFSPAIPTPGTGLPGAHTQPPQTDVDLGSQASFLPDPRAARNKPSRNLPFTGTNKSTKRANPFSFWRPNVSDT

SEQ ID NO: 753793 - protein, 464 aa, Homo sapiens [sequence omitted]

SEQ ID NO: 753794 - protein, 341 aa, Homo sapiens
MGFARFFSEESLQRSDAGNLQEPGFCRNHIVQRLCESKEDGQYGEVVSQIPNLDLNENISTGLKPCECSICGKVFVRHSLLNRHILAHSGYKPYGEKQYKCEQCGKFFVSVPGVRRHMIMHSGNPAYKCTICGKAFYFLNSVERHQRTHTGEKPYKCKQCGKAFTVSGSCLIHERTHTGEKPYECKECGKTFRFSCSFKTHERTHTGERPYKCTKCDKAFSCSTSLRYHGSIHTGERPYECKQCGKAFSRLSSLCNHRSTHTGEKPYECKQCDQAFSRLSSLHLHERIHTGEKPYECKKCGKAYTRSSHLTRHERSHDIEAGCSDSAYNPSTLGGQGVWIA

SEQ ID NO: 753795 - protein, 378 aa, Homo sapiens
MDSVAFEDVAVNFTQEEWALLDSSQKNLYREVMQETCRNLASVGSQWKDQNIEDHFEKPGKDIRNHIVQRLCESKEDGQYGEVVSQIPNLDLNENISTGLKPCECSICGKVFVRHSLLNRHILAHSGYKPYGEKQYKCEQCGKFFVSVPGVRRHMIMHSGNPAYKCTICGKAFYFLNSVERHQRTHTGEKPYKCKQCGKAFTVSGSCLIHERTHTGEKPYECKECGKTFRFSCSFKTHERTHTGERPYKCTKCDKAFSCSTSLRYHGSIHTGERPYECKQCGKAFSRLSSLCNHRSTHTGEKPYECKQCDQAFSRLSSLHLHERIHTGEKPYECKKCGKAYTRSSHLTRHERSHDIEAGCSDSAYNPSTLGGQGVWIA

SEQ ID NO: 753796 - protein, 411 aa, Homo sapiens
AEAEEQVSRGAMAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 753797 - protein, 194 aa, Homo sapiens
AEAEEQVSRGAMAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVRALGGWYTCQGPGRAPWCPVGN

SEQ ID NO: 753798 - protein, 113 aa, Homo sapiens
GRAGVSFIVDLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 753799 - protein, 368 aa, Homo sapiens
AEAEEQVSRGAMAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLPCVLVKKAATVGSRCAEAERRPRLGTGVHRLARPPS

SEQ ID NO: 753800 - protein, 356 aa, Homo sapiens
RARAGAPGFGSSWGDGRSRVGRPGAVTTLASWQVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 753801 - protein, 290 aa, Homo sapiens
MQAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 753802 - protein, 290 aa, Homo sapiens; identical to SEQ ID NO: 753801

SEQ ID NO: 753803 - protein, 411 aa, Homo sapiens; identical to SEQ ID NO: 753796

SEQ ID NO: 753804 - protein, 310 aa, Homo sapiens
MLPVLERQILVSSTHVLLGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 753805 - protein, 309 aa, Homo sapiens
MTQESMDLGQSGPCQTPSHFPTLPGRCNLLPSQPLQVHQGWRKDSPSPPQALLTPGGWTCCVFYFLRLSGGTELPLVLGAIGGAQNSLAVAVVLTSPPPLAAIPPLATRSAFVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLPCVLVKKAATVGSRCAEAERRPRLGTGVHRLARPPS

SEQ ID NO: 753806 - protein, 322 aa, Homo sapiens
AEAEEQVSRGAMAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVSSPAGTQGLHGQAGPTHCALLPLGLYLLRSQQGVRAGVRCDGAHCPPQTPDRPDLPQVWDPAAGHHCALWGEGDVGAASELGSGDRGCQQSRHHPVSRVQPEGSKEVPTPLVHDQAP

SEQ ID NO: 753807 - protein, 160 aa, Homo sapiens
LFQRIPDSAVQHVVSQNCDGLHLRSGLPRTAISELHGNMYIEVSSPAGTQGLHGQAGPTHCALLPLGLYLLRSQQGVRAGVRCDGAHCPPQTPDRPDLPQVWDPAAGHHCALWGEGDVGAASELGSGDRGCQQSRHHPVSRVQPEGSKEVPTPLVHDQAP

SEQ ID NO: 753808 - protein, 440 aa, Homo sapiens
RARAGAPGFGSSWGDGRSRVGRPGAVTTLASWQVCDDPEELRGKVRELASAVRNAKYLVVYTGAGISTVGREAEAYPRTEYELQYREKLAFKAALRFFLLKKRNDQNLPKAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVRADDTMSEPSPCLPEGVQLCGPALYRLVPCVCAVSVCLLPQVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 753809 - protein, 451 aa, Homo sapiens
AEAEEQVSRGAMAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREELRGKVRELASAVRNAKYLVVYTGAGISTAASIPDYRGPNGVWTLLQKGRSVSAAEPRLYADLFISIKRFCTGKK

SEQ ID NO: 753810 - protein, 79 aa, Homo sapiens
GSQARLMPLSLFGRWQDPIFSLATPLRAGEEGSHSRKSLCRSREEAPPGDRGAPLSSAPILGGWFGRGCTKRTKRKKVT

SEQ ID NO: 753811 - protein, 388 aa, Homo sapiens
AEAEEQVSRGAMAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVRADDTMSEPSPCLPEGVQLCGPALYRLVPCVCAVSVCLLPQVLKKYPRLWCMTKPPSRRPKLYIVNLQWTPKDDWAALKLHGKCDDVMRLLMAELGLEIPAYSR

SEQ ID NO: 753812 - protein, 313 aa, Homo sapiens
PGGGVLNRTRGNTCVVYTVLLGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 753813 - protein, 309 aa, Homo sapiens; identical to SEQ ID NO: 753805

SEQ ID NO: 753814 - protein, 415 aa, Homo sapiens
AEAEEQVSRGAMAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKFLAICP

SEQ ID NO: 753815 - protein, 442 aa, Homo sapiens
AEAEEQVSRGAMAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKPLALLRLYPDTAWPSRTPAHPASVSRGGSRTFL

SEQ ID NO: 753816 - protein, 346 aa, Homo sapiens
AEAEEQVSRGAMAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSR

SEQ ID NO: 753817 - protein, 130 aa, Homo sapiens
VGAKADRPPGRVGLLLLSLGFPCPQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKFLAICP

SEQ ID NO: 753818 - protein, 299 aa, Homo sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 753819 - protein, 299 aa, Homo sapiens; identical to SEQ ID NO: 753818

SEQ ID NO: 753820 - protein, 258 aa, Homo sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRFSDLTFCWSSFQRK

SEQ ID NO: 753821 - protein, 244 aa, Homo sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPR

SEQ ID NO: 753822 - protein, 246 aa, Homo sapiens
MTGGGRWKVEYKDHKEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 753823 - protein, 217 aa, Homo sapiens
AWRRLRLCLLHWHYCRCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 753824 - protein, 160 aa, Homo sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGKLLELFCKPEILTVVV

SEQ ID NO: 753825 - protein, 87 aa, Homo sapiens
MHSLATAAPVPTTLAQVDREKIYQWINELSSPETRENALLELSKKRESVPDLAPMLWHSFGTIAALLQEIVNIYPSINPPVDAAANL

SEQ ID NO: 753826 - protein, 102 aa, Homo sapiens
MHSLATAAVSGWAPRLGTRILSQTHVSAFSPNSRCRVPSLIFFCPQSPRPRFPSSARFGCGGAGPYFLAGRLSRPSARPIAFFAGAGAWSHARSRPFIDLLR

SEQ ID NO: 753827 - protein, 316 aa, Homo sapiens
MRAHAGHKRSECGGEWRETPRKQKQHGKASISPSSGARRTVTPTRKRPYECKVCGKAFNSPNLFQIHQRTHTGKRSYKCREIVRAFTVSSFFRKHGKMHTGEKRYECKYCGKPIDYPSLFQIHVRTHTGEKPYKCKQCGKAFISAGYLRTHEIRSHALEKSHQCQECGKKLSCSSSLHRHERTHSGGKLYECQKCAKVFRCPTSLQAHERAHTGERPYECNKCGKTFNYPSCFRRHKKTHSGEKPYECTRCGKAFGWCSSLRRHEMTHTGEKPFDCKQCGKVFTFSNYLRLHERTHLAGRSQCFGRRQGDHLSPGV

SEQ ID NO: 753828 - protein, 316 aa, Homo sapiens; identical to SEQ ID NO: 753827

SEQ ID NO: 753829 - protein, 118 aa, Homo sapiens [sequence omitted]

SEQ ID NO: 753830 - protein, 193 aa, Homo sapiens [sequence omitted]

SEQ ID NO: 753831 - protein, 346 aa, Homo sapiens
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTSASQALHSDWLARNCQPNYWRNVIPDPSKYCGPYKPPGILKQDIPIHKETEDDRGHDTIGMVVIHKTGHIAAGTSTNGIKFKIHGRVGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 753832 - protein, 209 aa, Homo sapiens [sequence omitted]

SEQ ID NO: 753833 - protein, 219 aa, Homo sapiens
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTSASQALHSDWLARNCQPNYWRNVIPDPSKYCGPYKPPGILKQDIPIHKETKAEKAAHSHHLVFLMCSKVFL

SEQ ID NO: 753834 - protein, 346 aa, Homo sapiens; identical to SEQ ID NO: 753831

SEQ ID NO: 753835 - protein, 227 aa, Homo sapiens
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTSASQALHSDWLARNCQPNYWRNVIPDPSKYCGPYKPPGILKQDIPIHKETEDDRGHDTIGMVVIHKTGHIAAGTSTNAV

SEQ ID NO: 753836 - protein, 209 aa, Homo sapiens [sequence omitted]

SEQ ID NO: 753837 - protein, 126 aa, Homo sapiens
TSSGDQKRLRPSTSVDEEDEESERERDRDMADTPCELAKRDPKGVGVRRRPARPLELDSGGEEDEKESLSASSSSSASSSSGSSTTSPSSSASDKEEEQESTEEEEEAEEEEEEEVPRSQLSSSST

SEQ ID NO: 753838 - protein, 117 aa, Homo sapiens
PSPALTPSLPAESERERDRDMADTPCELAKRDPKGVGVRRRPARPLELDSGGEEDEKESLSASSSSSASSSSGSSTTSPSSSASDKEEEQESTEEEEEAEEEEEEEVPRSQLSSSST

SEQ ID NO: 753839 - protein, 115 aa, Homo sapiens
MGALYLSIHVEKKTHPIASKSTTSLFKGTTQRNQTPFALFLKHLKKTSDGLTRCHPWSHRRDTLCKQSIRGSSLSVGAQCSENRGEVLPWKLARPQNMSFTHAAFFFSFSKRTKK

SEQ ID NO: 753840 - protein, 75 aa, Homo sapiens
ILRPRSVREWIWGHHCPRAPAPVGSSLGPPHGNLSSPELYSWPGVSGPHCRHDVGLDSFFTTPIGQSLVSPLLAK

SEQ ID NO: 753841 - protein, 104 aa, Homo sapiens
MKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 753842 - protein, 104 aa, Homo sapiens; identical to SEQ ID NO: 753841

SEQ ID NO: 753843 - protein, 104 aa, Homo sapiens; identical to SEQ ID NO: 753841

SEQ ID NO: 753844 - protein, 104 aa, Homo sapiens; identical to SEQ ID NO: 753841

SEQ ID NO: 753845 - protein, 104 aa, Homo sapiens; identical to SEQ ID NO: 753841

SEQ ID NO: 753846 - protein, 153 aa, Homo sapiens
MCVNFRNIENTNKQKEEEETDPISARSHCIQRRISKKEKKEGREVDRYKMKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 753847 - protein, 161 aa, Homo sapiens
ESRWTLCKRSRPTGAIPPASPPVEAQARFAAFSLCLITMSTNENANTPAARLHRFKNKGQDSTEMRRRENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 753848 - protein, 104 aa, Homo sapiens; identical to SEQ ID NO: 753841

SEQ ID NO: 753849 - protein, 104 aa, Homo sapiens; identical to SEQ ID NO: 753841

SEQ ID NO: 753850 - protein, 178 aa, Homo sapiens
LEDPGVPFVSSISSTSLNISSLLKFYLQGCCFQQDPKLEKEEEETDPISARSHCIQRRISKKEKKEGREVDRYKMKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 753851 - protein, 142 aa, Homo sapiens
LWIPGLQDSISDCAKSHCIQRRISKKEKKEGREVDRYKMKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 753852 - protein, 1016 aa, Homo sapiens
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 753853 - protein, 653 aa, Homo sapiens
WPSLVSRDRQPDVVANDMITYRLRHLLRARCDASPVTNNTIQFHCDPSFWAQNIINLGSLVIEDKESQPQMPKQNPVVEQNSQPPSGLSSNQLSKFPTQISLAQLRLQHMQQQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 753854 - protein, 94 aa, Homo sapiens
YPLVTLATSPRLATSPRLATSEFNEPDSEVANAGIKLENYFEELLKNLYPEKRFPKPEFRNESEDNKFSDDSDDDFVQPRKKRLKSIEERQLLK

SEQ ID NO: 753855 - protein, 1016 aa, Homo sapiens; identical to SEQ ID NO: 753852

SEQ ID NO: 753856 - protein, 953 aa, Homo sapiens
AQAGLKLLASSNPPASASQNVGITVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQVMAQRQQVQRRPAPVGLPNPRMQGPIQQPSISHQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 753857 - protein, 475 aa, Homo sapiens
RFRPERAGRVEAPAFPGLLQLPPLYCKTDGRKNMSDSAGGRAGLRRYPKLPVWVVEDHQEVLPFIYRAIGSKHLPASNVSFLHFDSHPDLLIPVNMPADTVFDKETLFGELSIENWIMPAVYAGHFSHVIWFHPTWAQQIREGRHHFLVGKDTSTTTIRVTSTDHYFLSDGLYVPEDQLENQKPLQLDVIMVKPYKLCNNQEENDAVSSAKKPKLALEDSENTASTNCDSSSEGLEKDTATQRSDQTCLEPSCSCSSENQECQTAASTGEILEILKKGKAFVLDIDLDFFSVKNPFKEMFTQEEYKILQELYQFKKPGTNLTEEDLVDIVDTRIHQLEDLEATFADLCDGDDEETVQRWASNPGMESLVPLVQSLKKRMEVPDYEMVHQAGLTCDYSELPHHISTEQEIECLIQSVHYLLKNLPNPTLVTIARSSLDDYCPSDQVDTIQEKVLNMLRALYGNLDLQVYAAESPPS

SEQ ID NO: 753858 - protein, 475 aa, Homo sapiens; identical to SEQ ID NO: 753857

SEQ ID NO: 753859 - protein, 401 aa, Homo sapiens
RFRPERAGRVEAPAFPGLLQLPPLYCKTDGRKNMSDSAGGRAGLRRYPKLPVWVVEDHQEVLPFIYRAIGSKHLPASNVSFLHFDSHPDLLIPVNMPADTVFDKETLFGELSIENWIMPAVYAGHFSHVIWFHPTWAQQIREGRHHFLVGKDTSTTTIRGLEKDTATQRSDQTCLEPSCSCSSENQECQTAASTGEILEILKKGKAFVLDIDLDFFSVKNPFKEMFTQEEYKILQELYQFKKPGTNLTEEDLVDIVDTRIHQLEDLEATFADLCDGDDEETVQRWASNPGMESLVPLVQSLKKRMEVPDYEMVHQAGLTCDYSELPHHISTEQEIECLIQSVHYLLKNLPNPTLVTIARSSLDDYCPSDQVDTIQEKVLNMLRALYGNLDLQVYAAESPPS

SEQ ID NO: 753860 - protein, 475 aa, Homo sapiens; identical to SEQ ID NO: 753857

SEQ ID NO: 753861 - protein, 95 aa, Homo sapiens
PRHIVEPNADPGLKTRWRDTASSPACLRLPKCWDYRCKSLPQPETNILKSYYQKNPTNLPIHESIIGSLPFQGIWHCGPALAKCSPALLVSRWSG

SEQ ID NO: 753862 - protein, 596 aa, Homo sapiens
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLIPFDGDLLSMESEGAFKECYLEGDQTSLYHAAKGLMTLQALYGTIPQIFGKGECARQVANMMIRMKREFTGSQNSIFPVFDNLLLLDRNVDLLTPLATQLTYGGLIDEIYGIQNSYVKLPPEKFAPKKQGDGGKDLPTEAKKLQLNSAEELYAEIRDKNFNAVGSVLSKKAKIISAAFEERHNAKTVGEIKQFVSQLPHMQAARGSLANHTSIAELIKDVTTSEDFFDKLTVEQEFMSGIDTDKVNNYIEDCIAQKHSLIKVLRLVCLQSVCNSGLKQKVLDYYKREILQTYGYEHILTLHNLEKAGLLKPQTGGRNNYPTIRKTLRLWMDDVNEQNPTDISYVYSGYAPLSVRLAQLLSRPGWRSIEEVLRILPGPHFEERQPLPTGLQKKRQPGENRVTLIFFLGGVTFAEIAALRFLSQLEDGGTEYVIATTKLMNGTSWIEALMEKPF

SEQ ID NO: 753863 - protein, 589 aa, Homo sapiens
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLLSMESEGAFKECYLEGDQTSLYHAAKGLMTLQALYGTIPQIFGKGECARQVANMMIRMKREFTGSQNSIFPVFDNLLLLDRNVDLLTPLATQLTYGGLIDEIYGIQNSYVKLPPEKFAPKKQGDGGKDLPTEAKKLQLNSAEELYAEIRDKNFNAVGSVLSKKAKIISAAFEERHNAKTVGEIKQFVSQLPHMQAARGSLANHTSIAELIKDVTTSEDFFDKLTVEQEFMSGIDTDKVNNYIEDCIAQKHSLIKVLRLVCLQSVCNSGLKQKVLDYYKREILQTYGYEHILTLHNLEKAGLLKPQTGGRNNYPTIRKTLRLWMDDVNEQNPTDISYVYSGYAPLSVRLAQLLSRPGWRSIEEVLRILPGPHFEERQPLPTGLQKKRQPGENRVTLIFFLGGVTFAEIAALRFLSQLEDGGTEYVIATTKLMNGTSWIEALMEKPF

SEQ ID NO: 753864 - protein, 443 aa, Homo sapiens
MESEGAFKECYLEGDQTSLYHAAKGLMTLQALYGTIPQIFGKGECARQVANMMIRMKREFTGSQNSIFPVFDNLLLLDRNVDLLTPLATQLTYGGLIDEIYGIQNSYVKLPPEKFAPKKQGDGGKDLPTEAKKLQLNSAEELYAEIRDKNFNAVGSVLSKKAKIISAAFEERHNAKTVGEIKQFVSQLPHMQAARGSLANHTSIAELIKDVTTSEDFFDKLTVEQEFMSGIDTDKVNNYIEDCIAQKHSLIKVLRLVCLQSVCNSGLKQKVLDYYKREILQTYGYEHILTLHNLEKAGLLKPQTGGRNNYPTIRKTLRLWMDDVNEQNPTDISYVYSGYAPLSVRLAQLLSRPGWRSIEEVLRILPGPHFEERQPLPTGLQKKRQPGENRVTLIFFLGGVTFAEIAALRFLSQLEDGGTEYVIATTKLMNGTSWIEALMEKPF

SEQ ID NO: 753865 - protein, 596 aa, Homo sapiens; identical to SEQ ID NO: 753862

SEQ ID NO: 753866 - protein, 494 aa, Homo sapiens
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLIPFDGDLLSMESEGAFKECYLEGDQTSLYHAAKGLMTLQALYGTIPQIFGKGECARQVANMMIRMKREFTGSQNSIFPVFDNLLLLDRNVDLLTPLATQLTYGGLIDEIYGIQNSYVKLPPEKFAPKKQGDGGKDLPTEAKKLQLNSAEELYAEIRDKNFNAVGSVLSKKAKIISAAFEERHNAKTVGEIKQFVSQLPHMQAARGSLANHTSIAELIKDVTTSEDFFDKLTVEQEFMSGIDTDKVNNYIEDCIAQKHSLIKVLRLVCLQSVCNSGLKQKVLDYYKREILQTYGYEHILTLHNLEKAGLLKPQTGGRNNYPTIRKTLRLWMDDVNEQVSHTSPPRLSLGTG

SEQ ID NO: 753867 - protein, 168 aa, Homo sapiens
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLIPFDGDLLSMESEGAFKIVLFESS

SEQ ID NO: 753868 - protein, 596 aa, Homo sapiens; identical to SEQ ID NO: 753862

SEQ ID NO: 753869 - protein, 596 aa, Homo sapiens; identical to SEQ ID NO: 753862

SEQ ID NO: 753870 - protein, 86 aa, Homo sapiens
MKGGALGVQPGAGVAPRLFCESRVSHCDSPAADELVYVRCFLRCLPRHRTGERSKNVDGPVSIHYRDHTCTLEALLKHLHLATCCS

SEQ ID NO: 753871 - protein, 408 aa, Homo sapiens
SDSPASAFRVAGITGMHQHAQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKVTGRKTDFTFFMIQNAGMLTGFTAILLITLYAGEIELE

SEQ ID NO: 753872 - protein, 460 aa, Homo sapiens
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKVTGRKTDFTFFMIQNAGMLTGFTAILLITLYAGEIELE

SEQ ID NO: 753873 - protein, 460 aa, Homo sapiens; identical to SEQ ID NO: 753872

SEQ ID NO: 753874 - protein, 243 aa, Homo sapiens [sequence omitted]

SEQ ID NO: 753875 - protein, 243 aa, Homo sapiens [sequence omitted]

SEQ ID NO: 753876 - protein, 240 aa, Homo sapiens
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFRLVTPSCLN

SEQ ID NO: 753877 - protein, 58 aa, Homo sapiens
MLTWRCSGGSRLKSDATVIIDLALGSAQDRQSARARSPVRHPVPEVKGAEKRSMWTGS

SEQ ID NO: 753878 - protein, 460 aa, Homo sapiens; identical to SEQ ID NO: 753872

SEQ ID NO: 753879 - protein, 366 aa, Homo sapiens
RGVSPRTCQRYRGCGGGRQKEREIQRPSLTLTRREKDAETDKQTDRRGSPGGRGAHSAYRSPRLRCHFNAPQVASCCSFEGVGEPGASRATSDSEQRRALTLPPLGKDASAPARVPLRSSSTCWSRWEPPPAWASRSLASCTSTSWELKVPTAIGAVLNSKDEQRATCEHKQKLAGLPYEYLCSKMQNCKYLDEGDDSMNDKLGRLSGLHLNGPRLTHTLGHTEHEDRRKDSKTVFLQGTPRRPIPLTDYRPTPAERRTMTPALPSRHVRYTRPCLGKNPSPVGTLSGQGRAPVNSSTPRRQSRPTQRTKTPPHGATHEPPFAHPHPDPPPTPGRALAHPRGTPTDARAPPPARPNPRPSPAYPHT

SEQ ID NO: 753880 - protein, 460 aa, Homo sapiens; identical to SEQ ID NO: 753872

SEQ ID NO: 753881 - protein, 243 aa, Homo sapiens [sequence omitted]

SEQ ID NO: 753882 - protein, 460 aa, Homo sapiens; identical to SEQ ID NO: 753872

SEQ ID NO: 753883 - protein, 103 aa, Homo sapiens
CLSGEILEPVSKPPRLFKDPTTGLYSRPLVSTYLPSYTMPLPSPPTLTHPLPPNPHSLRLALYHPPTLLSVEAGTFLRDTSLAVLFLRLWGLRRADETLKYFI

SEQ ID NO: 753884 - protein, 103 aa, Homo sapiens; identical to SEQ ID NO: 753883

SEQ ID NO: 753885 - protein, 496 aa, Homo sapiens
TWSGAGHMEPGLEHALRRTPSWSSLGGSEHQEMSFLEQENSSSWPSPAVTSSSERIRGKRRAKALRWTRQKSVEEGEPPGQGEGPRSRPAAESTGLEATFPKTTPLAQADPAGVGTPPTGWDCLPSDCTASAAGSSTDDVELATEFPATEAWECELEGLLEERPALCLSPQAPFPKLGWDDELRKPGAQIYMRFMQEHTCYDAMATSSKLVIFDTMLEIKKAFFALVANGVRAAPLWDSKKQSFVGMLTITDFILVLHRYYRSPLVQIYEIEQHKIETWREIYLQGCFKPLVSISPNDSLFEAVYTLIKNRIHRLPVLDPVSGNVLHILTHKRLLKFLHIFGSLLPRPSFLYRTIQDLGIGTFRDLAVVLETAPILTALDIFVDRRVSALPVVNECGQVVGLYSRFDVIHLAAQQTYNHLDMSVGEALRKRTLCLEGVLSCQPHESLGEVIDRIAREQVHRLVLVDETQHLLGVVSLSDILQALVLSPAGIDALGA

SEQ ID NO: 753886 - protein, 111 aa, Homo sapiens
EYGKELDERCRRVSEAPSLPVVFIDGHYLGGAEKILSMNESGELQDILTKIERVQHPHECPSCGGFGFLPCSVCHGSKMSMFRNCFTDSFKALKCTACNENGLQRCKNCAG

SEQ ID NO: 753887 - protein, 111 aa, Homo sapiens; identical to SEQ ID NO: 753886

SEQ ID NO: 753888 - protein, 129 aa, Homo sapiens
MEILSSPWKESLFFPSSCTSPQVESHWPAGPMPIPEQYCNWSPAVTCPVTAGRWGWASYPKESPGAVPRRENGCGAEQTVDVYLTQPDKTACKNQAYGPAPLCRPTLYTPEMPFLSLANPHSPFQSQLI

SEQ ID NO: 753889 - protein, 72 aa, Homo sapiens
PSGAPTLPFAPDECSLTPGSPPHPLNKQKHHPPHPSQTQKDLVPRSPQLEKSRIRLRRTLRNLGGGRGQRGQ

SEQ ID NO: 753890 - protein, 49 aa, Homo sapiens [sequence omitted]

SEQ ID NO: 753891 - protein, 156 aa, Homo sapiens
RVRGCDAPPCCRNPGPWRLPADGKGVLRAWSPERGQLLTPFPGKGPGREHMGAASAGKRGQKGSWQQTPGSEWANLDYPGPGLTYKTAKDSFRWATGEHQAFTSFAFGQPDNHGFGNCVELQASAAFNWNDQRCKTRNRYICQFAQEHISRWGPGS

SEQ ID NO: 753892 - protein, 85 aa, Homo sapiens
SDFETRNFWIGLTYKTAKDSFRWATGEHQAFTSFAFGQPDNHGFGNCVELQASAAFNWNDQRCKTRNRYICQFAQEHISRWGPGS

SEQ ID NO: 753893 - protein, 123 aa, Homo sapiens
QPFGNKNRCYCSSLENVASGDGTLEIRVNVLERGSRVNKAQPKDAVEPFSLEIFGSEVGFSHSHPCPCGYHYPISLDRVGRGGVWRRNELACGPQAPSVLAQVWVPFFTLVCSLTHTSHTLLV

SEQ ID NO: 753894 - protein, 237 aa, Homo sapiens
MEDGGQREERKRNAKCGQPPRVKIEGSVMQVLDRRRQVGRAPQPPPQKRPPPGLSDPWGAGSASPRPHVAPAPMVPVPWMETASSGGQMWCSGIQSHFLPGHACPAASLAAFSPYLPGDPGWGTRAPGGRAQRDQGKPLAWRVWGTLPQGRTQQEEAQELGPAAQELGPATQAGLGTWQGLGILALDLGDLGGTGRGEMGGPAPAQCRPHPCTEAPPCHTPRRLPELKPRPQQREHP

SEQ ID NO: 753895 - protein, 110 aa, Homo sapiens
MEGEGGPEGAGRETRASIHPPLRTDRHHSEREARAPLGGAARPSEGPQHLSHVLLQESTSARGQCQRRSTGRGGHRQAGPGPGGDEGEPAGAAGQVLQLVGDHKEGHGKF

SEQ ID NO: 753896 - protein, 198 aa, Homo sapiens
LADVTALLRAPATPGRLVAGARGGWGYVQSCRGAGAAAVKALGSAETAVPTARLGCRRFSRSRCCRRRGRGSLLSFSAAKVRSCLGSARGGAPGAARDGGGHLDSEQEAPRPMPNIPGDLESREAMVAFFNSAGASAQEEQRVCCQPLAHPVASSQKKPEVAAPAPESGGESVFGETHRALQGAMEKLQRLYGRRRWT

SEQ ID NO: 753897 - protein, 237 aa, Homo sapiens; identical to SEQ ID NO: 753894

SEQ ID NO: 753898 - protein, 237 aa, Homo sapiens; identical to SEQ ID NO: 753894

SEQ ID NO: 753899 - protein, 76 aa, Homo sapiens
KDTGAGLIQDSFLEEAGFKLVNEAPRNPSGCEVQSSARCWSLKKEPHEGNNHERTVVLCEEEMKLIHDNGDENPSS

SEQ ID NO: 753900 - protein, 69 aa, Homo sapiens
PFPVQDPHLRSWEPRCTPGVPFQPPQCECGRALTFGGSLPRLTGSLCGSPARCPGSDVAAPRRGAPAET

SEQ ID NO: 753901 - protein, 69 aa, Homo sapiens; identical to SEQ ID NO: 753900

SEQ ID NO: 753902 - protein, 392 aa, Homo sapiens [sequence omitted]

SEQ ID NO: 753903 - protein, 620 aa, Homo sapiens [sequence omitted]

SEQ ID NO: 753904 - protein, 748 aa, Homo sapiens
MAPDSDPFPEGPLLKLLPLDARDRGTQRCRLGPAALHALGARLGSAVKISLPDGGSCLCTAWPRRDGADGFVQLDPLCASPGAAVGASRSRRSLSLNRLLLVPCPPLRRVAVWPVLRERAGAPGARNTAAVLEAAQELLRNRPISLGHVVVAPPGAPGLVAALHIVGGTPSPDPAGLVTPRTRVSLGGEPPSEAQPQPEVPLGGLSEAADSLRELLRLPLRYPRALTALGLAVPRGVLLAGPPGVGKTQLVQAVAREAGAELLAVSAPALQGSRPGETEENVRRVFQRARELASRGPSLLFLDEMDALCPQRGSRAPESRVVAQVLTLLDGASGDREVVVVGATNRPDALDPALRRPGRFDREVVIGTPTLKQRKEILQVITSKMPISSHVDLGLLAEMTVGYVGADLTALCREAAMHALLHSEKFQFDHKHLSLRWTSQLLSSQGGAHCYFRRGLLRCSYQQVMAEFRNNPGEVEGRKAKSMKGQTTGKNQDNPVIDEIDFLEAFKNIQPSSFRSVIGLMDIKPVDWEEIGGLEDVKLKLKQIFRQARASTPAILFLDEIDSILGARSASKTGCDVQERVLSVLLNELDGVGLKTIERRGSKSSQQEFQEVFNRSVMIIAATNRPDVLDTALLRPGRLDKIIYIPPPDHKGRLSILKVCTKTMPIGPDVSLENLAAETCFFSGADLRNLCTEAALLALQENGLDATTVKQEHFLKSLKTVKPSLSCKDLALYENLFKKEGFSNVEGI

SEQ ID NO: 753905 - protein, 753 aa, Homo sapiens
MAPDSDPFPEGPLLKLLPLDARDRGTQRCRLGPAALHALGARLGSAVKISLPDGGSCLCTAWPRRDGADGFVQLDPLCASPGAAVGASRSRRSLSLNRLLLVPCPPLRRVAVWPVLRERAGAPGARNTAAVLEAAQELLRNRPISLGHVVVAPPGAPGLVAALHIVGGTPSPDPAGLVTPRTRVSLGGEPPSEAQPQPEVPLGGLSEAADSLRELLRLPLRYPRALTALGLAVPRGVLLAGPPGVGKTQLVQAVAREAGAELLAVSAPALQGSRPGETEENVRRVFQRARELASRGPSLLFLDEMDALCPQRGSRAPESRVVAQVLTLLDGASGDREVVVVGATNRPDALDPALRRPGRFDREVVIGTPTLKQRKEILQVITSKMPISSHVDLGLLAEMTVGYVGADLTALCREAAMHALLHSEKNQDNPVIDEIDFLEAFKNIQPSSFRSVIGLMDIKPVDWEEIGGLEDVKLKLKQSIEWPLKFPWEFVRMGLTQPKGVLLYGPPGCAKTTLVRALATSCHCSFVSVSGADLFSPFVGDSEKVLSQIFRQARASTPAILFLDEIDSILGARSASKTGCDVQERVLSVLLNELDGVGLKTIERRGSKSSQQEFQEVFNRSVMIIAATNRPDVLDTALLRPGRLDKIIYIPPPDHKGRLSILKVCTKTMPIGPDVSLENLAAETCFFSGADLRNLCTEAALLALQENGLDATTVKQEHFLKSLKTVKPSLSCKDLALYENLFKKEGFSNVEGI

SEQ ID NO: 753906 - protein, 620 aa, Homo sapiens [sequence omitted]

SEQ ID NO: 753907 - protein, 818 aa, Homo sapiens
MAPDSDPFPEGPLLKLLPLDARDRGTQRCRLGPAALHALGARLGSAVKISLPDGGSCLCTAWPRRDGADGFVQLDPLCASPGAAVGASRSRRSLSLNRLLLVPCPPLRRVAVWPVLRERAGAPGARNTAAVLEAAQELLRNRPISLGHVVVAPPGAPGLVAALHIVGGTPSPDPAGLVTPRTRVSLGGEPPSEAQPQPEVPLGGLSEAADSLRELLRLPLRYPRALTALGLAVPRGVLLAGPPGVGKTQLVQAVAREAGAELLAVSAPALQGSRPGETEENVRRVFQRARELASRGPSLLFLDEMDALCPQRGSRAPESRVVAQVLTLLDGASGDREVVVVGATNRPDALDPALRRPGRFDREVVIGTPTLKQRKEILQVITSKMPISSHVDLGLLAEMTVGYVGADLTALCREAAMHALLHSEKFQFDHKHLSLRWTSQLLSSQGGAHCYFRRGLLRCSYQQVMAEFRNNPGEVEGRKAKSMKGQTTGKNQDNPVIDEIDFLEAFKNIQPSSFRSVIGLMDIKPVDWEEIGGLEDVKLKLKQSIEWPLKFPWEFVRMGLTQPKGVLLYGPPGCAKTTLVRALATSCHCSFVSVSGADLFSPFVGDSEKVLSQIFRQARASTPAILFLDEIDSILGARSASKTGCDVQERVLSVLLNELDGVGLKTIERRGSKSSQQEFQEVFNRSVMIIAATNRPDVLDTALLRPGRLDKIIYIPPPDHKGRLSILKVCTKTMPIGPDVSLENLAAETCFFSGADLRNLCTEAALLALQENGLDATTVKQEHFLKSLKTVKPSLSCKDLALYENLFKKEGFSNVEGI

SEQ ID NO: 753908 - protein, 53 aa, Homo sapiens
PAVARRCPKLTQDTELEVFGLLPNSVGCNAGVVASTGQVCLEDLQEDSVWGDV

SEQ ID NO: 753909 - protein, 110 aa, Homo sapiens
KVEVDLDQTQRERKMQNALGRGKVVPLWHPAHLQTLPVTPNKQKTDGRGTKPEASSHQGTPKQTTAQGAPKTSFIAAKGTQVVKISVHMGRVSLKQEPRKSHSPSSDTSK

SEQ ID NO: 753910 - protein, 207 aa, Homo sapiens
EPGFCAPLSRCEVLTRPSPCSPRRLGPHALGSKTHSEAPDPFLLSCDPLCETPKEAKDHSRCFIKMVTVSPRLGCWYLNIPLQRDPAPPNPIPQAAKTDLMPSFSGRIWRDIEGHGWRPRLAGFVVRKTEPRESPAPFCSQNLRGLVTGPGPRGIWRQRFLDVWGLTARLGATGFPGLRTLRFRGRALSSPLLDLRPNPSNFQHSSP

SEQ ID NO: 753911 - protein, 148 aa, Homo sapiens
MNFNPCCVSPNSLQTLFALGFCFSHSPHPRIPYPRLQSTDLMPSFSGRIWRDIEGHGWRPRLAGFVVRKTEPRESPAPFCSQNLRGLVTGPGPRGIWRQRFLDVWGLTARLGATGFPGLRTLRFRGRALSSPLLDLRPNPSNFQHSSP

SEQ ID NO: 753912 - protein, 269 aa, Homo sapiens
MEPWPLLLLFSLCSAGLVLGSEHETRLVAKLFKDYSSVVRPVEDHRQVVEVTVGLQLIQLINVDEVNQIVTTNVRLKQQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGGCGCHDCCC

SEQ ID NO: 753913 - protein, 457 aa, Homo sapiens
MEPWPLLLLFSLCSAGLVLGSEHETRLVAKLFKDYSSVVRPVEDHRQVVEVTVGLQLIQLINVDEVNQIVTTNVRLKQQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 753914 - protein, 457 aa, Homo sapiens; identical to SEQ ID NO: 753913

SEQ ID NO: 753915 - protein, 457 aa, Homo sapiens; identical to SEQ ID NO: 753913

SEQ ID NO: 753916 - protein, 482 aa, Homo sapiens
MEPWPLLLLFSLCSAGLVLGSEHETRLVAKLFKDYSSVVRPVEDHRQVVEVTVGLQLIQLINVDEVNQIVTTNVRLKQGDMVDLPRPSCVTLGVPLFSHLQNEQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 753917 - protein, 191 aa, Homo sapiens
QFCIDKVNISQNTMSLQFSNGSRHVCLRSGAGSVRPLNGGAGFAGSSACGGSVAGSEFSCALGGGLGSVPGGSHAGGALGNAACIGFAGSEGGLLSGNEKVTMQNLNDRLASYLDNVRALEEANAELERKIKGWYEKYGPGSCRGLDHDYSRYHLTIEDLKNKIISSTTTNANVILQIDNARLAADDFRLK

SEQ ID NO: 753918 - protein, 146 aa, Homo sapiens
HGGYTGSGPGFGEPRDSGAEVPSGSGRATGCERGGVRGARQGRAPGSSIWRKEPRMVCTRKTKTLVSTCVILSGMTNIICLLYVGWVTNYIASVYVRGQEPAPDKKLEEDKGDTLKIIERLDHLENVIKQHIQGYRRNFSLLNVSN

SEQ ID NO: 753919 - protein, 267 aa, Homo sapiens
VIVAQSGPALGEALPHVVPTLRACLQPSQDPQMRLKLFSILSTALLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIKIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 753920 - protein, 692 aa, Homo sapiens
GCRDAPQRMVAPGAALSDLSPAPSGSGRQHKAVAMAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGVGKLRKQWLKESISDVGFGMLKSVKEYVDPNNIFGNRNLL

SEQ ID NO: 753921 - protein, 692 aa, Homo sapiens; identical to SEQ ID NO: 753920

SEQ ID NO: 753922 - protein, 692 aa, Homo sapiens; identical to SEQ ID NO: 753920

SEQ ID NO: 753923 - protein, 91 aa, Homo sapiens
LVDLIDEVGSMTICCLRRHRFLSKRTNLPLESGVSDFKPGQSECTDPWPLGCTAFECKPAGIPDFSDHREVRDALQTTAHASGPVQEATVR

SEQ ID NO: 753924 - protein, 114 aa, Homo sapiens
CTFKKRRLNQSTCTNYDTPLWLNTGKPPARKDDPLHDPTKDKTNLIVYIICGVVAVMVLVGIFTKLGLEKAHRPQREHMSRLYDNLLFTEAQISFQEDEPAPGEWSVGLQTWTV

SEQ ID NO: 753925 - protein, 103 aa, Homo sapiens
KSADHLNGLLREVEATSAVLMEQIKLLKSEIRRLERNQEQEVSAANVEHLKNVLLQFIFLKPGSERERLLPVINTMLQLSLEEKGKLAAVAQGLQETSIPKKK

SEQ ID NO: 753926 - protein, 303 aa, Homo sapiens
AGWYRPGVRDRGLGARRRSVSPSGRLLSPMADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQHDSTFPLIDSSSQNQIRKRIVLEKLSKVLPGLLVPLQITLGDIYTQLKNLVRTFRLTNRNIIHKPAEWTLIAMVLLSLLTQFWITNILRNVWCSRSRTPS

SEQ ID NO: 753927 - protein, 504 aa, Homo sapiens
AGWYRPGVRDRGLGARRRSVSPSGRLLSPMADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQSGHSGEEVQLCSKAIKTSDIDNPSHFEKQYESSSSSTHSDSSSDNEQDFVSSILPGNRPNSTNIRPQLHQKSIMKKKAGHKANSKHKDKEQTVVDVTEQLGDCKLDSQEKDATCELPLQKVNTQSSSNSTLPERLKASENSESEYSRSEITLVGISKKSAEHFKRKFAKSNQVSRSVSSSVQVCPEVGKRNLLKVLKETLIEWKTEETLRFLYGQNYASVCLKPEASLVKEELDEDDIISDPDSHFPAWRESQNSLDESLPFRGSGTAIKPLPSYENLKKETEKLNLRIREFYRGRYVLGD

SEQ ID NO: 753928 - protein, 214 aa, Homo sapiens
AVCTPGSDIDEDDIISDPDSHFPAWRESQNSLDESLPFRGSGTAIKPLPSYENLKKETEKLNLRIREFYRGRYVLGEETTKSQDSEEHDSTFPLIDSSSQNQIRKRIVLEKLSKVLPGLLVPLQITLGDIYTQLKNLVRTFRLTNRNIIHKPAEWTLIAMVLLSLLTPILGIQKHSQEGMVFTRFLDTLLEELHLKNEDLESLTIIFRTSCLPE

SEQ ID NO: 753929 - protein, 574 aa, Homo sapiens
AGWYRPGVRDRGLGARRRSVSPSGRLLSPMADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQSGHSGEEVQLCSKAIKTSDIDNPSHFEKQYESSSSSTHSDSSSDNEQDFVSSILPGNRPNSTNIRPQLHQKSIMKKKAGHKANSKHKDKEQTVVDVTEQLGDCKLDSQEKDATCELPLQKVNTQSSSNSTLPERLKASENSESEYSRSEITLVGISKKSAEHFKRKFAKSNQVSRSVSSSVQVCPEVGKRNLLKVLKETLIEWKTEETLRFLYGQNYASVCLKPEASLVKEELDEDDIISDPDSHFPAWRESQNSLDESLPFRGSGTAIKPLPSYENLKKETEKLNLRIREFYRGRYVLGEETTKSQDSEEVCLTDIEFFQIVNIWKTHHSKSWSRKDIEELIVKFSNSFFSHSAFWFTVPSPLLALLFYK

SEQ ID NO: 753930 - protein, 641 aa, Homo sapiens
AGWYRPGVRDRGLGARRRSVSPSGRLLSPMADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQSGHSGEEVQLCSKAIKTSDIDNPSHFEKQYESSSSSTHSDSSSDNEQDFVSSILPGNRPNSTNIRPQLHQKSIMKKKAGHKANSKHKDKEQTVVDVTEQLGDCKLDSQEKDATCELPLQKVNTQSSSNSTLPERLKASENSESEYSRSEITLVGISKKSAEHFKRKFAKSNQVSRSVSSSVQVCPEVGKRNLLKVLKETLIEWKTEETLRFLYGQNYASVCLKPEASLVKEELDEDDIISDPDSHFPAWRESQNSLDESLPFRGSGTAIKPLPSYENLKKETEKLNLRIREFYRGRYVLGEETTKSQDSEEHDSTFPLIDSSSQNQIRKRIVLEKLSKVLPGLLVPLQITLGDIYTQLKNLVRTFRLTNRNIIHKPAEWTLIAMVLLSLLTPILGIQKHSQEGMVFTRFLDTLLEELHLKNEDLESLTIIFRTSCLPE

SEQ ID NO: 753931 - protein, 595 aa, Homo sapiens
AGWYRPGVRDRGLGARRRSVSPSGRLLSPMADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQSGHSGEEVQLCSKAIKTSDIDNPSHFEKQYESSSSSTHSDSSSDNEQDFVSSILPGNRPNSTNIRPQLHQKSIMKKKAGHKANSKHKDKEQTVVDVTEQLGDCKLDSQEKDATCELPLQKVNTQSSSNSTLPERLKASENSESEYSRSEITLVGISKKSAEHFKRKFAKSNQVSRSVSSSVQVCPEVGKRNLLKVLKETLIEWKTEETLRFLYGQNYASVCLKPEASLVKEELDEDDIISDPDSHFPAWRESQNSLDESLPFRGSGTAIKPLPSYENLKKETEKLNLRIREFYRGRYVLGEETTKSQDSEEHDSTFPLIDSSSQNQIRKRIVLEKLSKVLPGLLVPLQITLGDIYTQLKNLVRTFRLTNRNIIHKPAEWTLIAMVLLSLYIP

SEQ ID NO: 753932 - protein, 249 aa, Homo sapiens
DSRGPRRVSALIEWKTEETLRFLYGQNYASVCLKPEASLVKEELDEDDIISDPDSHFPAWRESQNSLDESLPFRGSGTAIKPLPSYENLKKETEKLNLRIREFYRGRYVLGEETTKSQDSEEHDSTFPLIDSSSQNQIRKRIVLEKLSKVLPGLLVPLQITLGDIYTQLKNLVRTFRLTNRNIIHKPAEWTLIAMVLLSLLTPILGIQKHSQEGMVFTRFLDTLLEELHLKNEDLESLTIIFRTSCLPE

SEQ ID NO: 753933 - protein, 104 aa, Homo sapiens
MRLFLSLPVLVVVLSIVLEAQAPAQGTPDVSSALDKLKEFGNTLEDKARELISRIKQSELSAKMREWFSETFQKVKEKLKIDYEDLKGDIQEGPLKFPTPQRLC

SEQ ID NO: 753934 - protein, 104 aa, Homo sapiens
MGKGSFKYAWVLDKLKAERERGITIDISLWKFETSKYYVTIIDAPGHRDFIKNMITGTSQADCAVLIVAAGVGEFEAGISKNGQTREHALLAYTLGVKQPNCRC

SEQ ID NO: 753935 - protein, 130 aa, Homo sapiens
MVVTFAPVNVTTEVKSVEMHHEALSEALPGDNVGFNVKNVSVKDVRRGNVAGDSKNDPPMEAAGFTAQKGDCFMPVISDLGNKRYAVGCHGSDTWTEISVKGGNRWIGYDTWTHRKENRKNGLPLLRSNW

SEQ ID NO: 753936 - protein, 114 aa, Homo sapiens
MSTKLVWVLFLLAEWRLLVLKPGMVSTWFSHVTGSTTANAMKLSEALRARAPMQEWLQEFAWTCGTQRPTGQGSRRDRNRKNDRVPGIHGNKAKKQNRGSQTHLEDSADDHKHK

SEQ ID NO: 753937 - protein, 104 aa, Homo sapiens; identical to SEQ ID NO: 753934

SEQ ID NO: 753938 - protein, 104 aa, Homo sapiens; identical to SEQ ID NO: 753934

SEQ ID NO: 753939 - protein, 187 aa, Homo sapiens
MVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 753940 - protein, 187 aa, Homo sapiens; identical to SEQ ID NO: 753939

SEQ ID NO: 753941 - protein, 187 aa, Homo sapiens; identical to SEQ ID NO: 753939

SEQ ID NO: 753942 - protein, 187 aa, Homo sapiens; identical to SEQ ID NO: 753939

SEQ ID NO: 753943 - protein, 187 aa, Homo sapiens; identical to SEQ ID NO: 753939

SEQ ID NO: 753944 - protein, 187 aa, Homo sapiens; identical to SEQ ID NO: 753939

SEQ ID NO: 753945 - protein, 187 aa, Homo sapiens; identical to SEQ ID NO: 753939

SEQ ID NO: 753946 - protein, 187 aa, Homo sapiens; identical to SEQ ID NO: 753939

SEQ ID NO: 753947 - protein, 187 aa, Homo sapiens; identical to SEQ ID NO: 753939

SEQ ID NO: 753948 - protein, 187 aa, Homo sapiens; identical to SEQ ID NO: 753939

SEQ ID NO: 753949 - protein, 187 aa, Homo sapiens; identical to SEQ ID NO: 753939

SEQ ID NO: 753950 - protein, 187 aa, Homo sapiens; identical to SEQ ID NO: 753939

SEQ ID NO: 753951 - protein, 104 aa, Homo sapiens; identical to SEQ ID NO: 753934

SEQ ID NO: 753952 - protein, 104 aa, Homo sapiens; identical to SEQ ID NO: 753934

SEQ ID NO: 753953 - protein, 104 aa, Homo sapiens; identical to SEQ ID NO: 753934

SEQ ID NO: 753954 - protein, 104 aa, Homo sapiens; identical to SEQ ID NO: 753934

SEQ ID NO: 753955 - protein, 104 aa, Homo sapiens; identical to SEQ ID NO: 753934

SEQ ID NO: 753956 - protein, 104 aa, Homo sapiens; identical to SEQ ID NO: 753934

SEQ ID NO: 753957 - protein, 104 aa, Homo sapiens; identical to SEQ ID NO: 753934

SEQ ID NO: 753958 - protein, 104 aa, Homo sapiens; identical to SEQ ID NO: 753934

SEQ ID NO: 753959 - protein, 117 aa, Homo sapiens
MGNKSTPLRGLGKWPSWGTNSLPFDRALGPGILTTKLRPERTVRSDEGGRNCVEENMRGVRFDVHDVTLHADAIHRGGGQIIPTARGCLYASVLTAQTRLMEPIYLVEIQCPEPGGP

SEQ ID NO: 753960 - protein, 104 aa, Homo sapiens; identical to SEQ ID NO: 753934

SEQ ID NO: 753961 - protein, 187 aa, Homo sapiens; identical to SEQ ID NO: 753939

SEQ ID NO: 753962 - protein, 187 aa, Homo sapiens; identical to SEQ ID NO: 753939

SEQ ID NO: 753963 - protein, 187 aa, Homo sapiens; identical to SEQ ID NO: 753939

SEQ ID NO: 753964 - protein, 187 aa, Homo sapiens; identical to SEQ ID NO: 753939

SEQ ID NO: 753965 - protein, 187 aa, Homo sapiens; identical to SEQ ID NO: 753939

SEQ ID NO: 753966 - protein, 187 aa, Homo sapiens; identical to SEQ ID NO: 753939

SEQ ID NO: 753967 - protein, 187 aa, Homo sapiens; identical to SEQ ID NO: 753939

SEQ ID NO: 753968 - protein, 187 aa, Homo sapiens; identical to SEQ ID NO: 753939

SEQ ID NO: 753969 - protein, 187 aa, Homo sapiens; identical to SEQ ID NO: 753939

SEQ ID NO: 753970 - protein, 187 aa, Homo sapiens; identical to SEQ ID NO: 753939

SEQ ID NO: 753971 - protein, 104 aa, Homo sapiens; identical to SEQ ID NO: 753934

SEQ ID NO: 753972 - protein, 104 aa, Homo sapiens; identical to SEQ ID NO: 753934

SEQ ID NO: 753973 - protein, 219 aa, Homo sapiens
CQLDELVVDAYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 753974 - protein, 104 aa, Homo sapiens; identical to SEQ ID NO: 753934

SEQ ID NO: 753975 - protein, 104 aa, Homo sapiens; identical to SEQ ID NO: 753934

SEQ ID NO: 753976 - protein, 171 aa, Homo sapiens [sequence omitted]

SEQ ID NO: 753977 - protein, 830 aa, Homo sapiens
ASPEGGGERRGLAGSGGGGAGQRGRGGVPGPPPASSHRGPFRSLHRTPLGPQAAGAVATQVSPAVPLPPRRPSGMDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 753978 - protein, 817 aa, Homo sapiens
PSKGDSSAPRTRAEGVVSIKHWRRHCPGPGSAQAGALWRAMQCLGIRSRSRSRELYLQERSLKVAALNGRRLGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 753979 - protein, 842 aa, Homo sapiens
PSKGDSSAPRTRAEGVVSIKHWRRHCPGPGSAQAGALWRAMQCLGIRSRSRSRELYLQERSLKVAALNGRRLGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKVGVPWQVRSGMLGVAHHSKCPLGLQASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 753980 - protein, 56 aa, Homo sapiens
MVPVPLGFNPWWDTEFAFEVVVPDLALIRFLVEDYDASSKNDFIGQSTIPLNSLKQ

SEQ ID NO: 753981 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 753982 - protein, 739 aa, Homo sapiens; identical to SEQ ID NO: 753981

SEQ ID NO: 753983 - protein, 647 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQAFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 753984 - protein, 678 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSHL

SEQ ID NO: 753985 - protein, 119 aa, Homo sapiens
GAMKVKAGAPRFPRPLQSRASSAASVTAALPTPAELEVLSSLLLSGVFKGGGQGMGPEVLRLRGGGQGPSTSLHQEGKGLWGQVAAIPHQEIQGHRFFPTPLNSGPSHPQTSKSHFCDM

SEQ ID NO: 753986 - protein, 402 aa, Homo sapiens
SRSRYRRPAGRRLLSRVEAAEPEPGEGAAAVSRTTAAPAAPHRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 753987 - protein, 478 aa, Homo sapiens
SRSRYRRPAGRRLLSRVEAAEPEPGEGAAAVSRTTAAPAAPHRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKHNTPNTHSTQCAPSLMSTGHWQLFLKCKKKPLVFRKMFLSLTPFRAGLPGGSGREVGRASPGQGSMFMSLAFNPVSTAVAGE

SEQ ID NO: 753988 - protein, 450 aa, Homo sapiens
PGPAIGGRRAGDSCPGWRRRSRSRGRGQRLSHGPRRRPQLLTAAPPLQARGAFRSFPHSWGEDFLASLMFKIQLEPLKLRAWTLNGFVKFRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 753989 - protein, 420 aa, Homo sapiens
MFKRTVLSCPPPAAPPLQARGAFRSFPHSWGEDFLASLMFKIQLEPLKLRAWTLNGFVKFRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 753990 - protein, 450 aa, Homo sapiens; identical to SEQ ID NO: 753988

SEQ ID NO: 753991 - protein, 439 aa, Homo sapiens
PVPLSAAGGQATPVPGGGGGAGAGGGGSGCLTDHGGARSSSPVRHLLRQTGLAGHAPLRVQGGGFQSCSTSGRLRWSDQRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 753992 - protein, 348 aa, Homo sapiens
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 753993 - protein, 220 aa, Homo sapiens
MDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 753994 - protein, 318 aa, Homo sapiens
SRSRYRRPAGRRLLSRVEAAEPEPGEGAAAVSRTTAAPAAPHRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATHQPPRFSPPPEPRDGVGVEVLFYALNEPPA

SEQ ID NO: 753995 - protein, 111 aa, Homo sapiens
TFHLTSRANPLSLVPGREGLSSYAPTLHEAGGSWAWQTPRSTWGAEDSPQRQGCWTEGRRDAEPTPGQCPHLAYDLATSTKVAVGHGPGPWVTRHSAPPHSPASSAAMSGR

SEQ ID NO: 753996 - protein, 968 aa, Homo sapiens
DNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNLFEKLLSKFQNRVISTYHHCCYTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSGIVNMDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 753997 - protein, 609 aa, Homo sapiens
DNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNLFEKLLSKFQNRVISTYHHCCYTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPQFVYISRT

SEQ ID NO: 753998 - protein, 279 aa, Homo sapiens
MDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 753999 - protein, 421 aa, Homo sapiens
DNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDLDNRIVNMDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 754000 - protein, 88 aa, Homo sapiens
PPLGGRLMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 754001 - protein, 763 aa, Homo sapiens
DNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNLFEKLLSKFQNRVISTYHHCCYTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSGIVNMDSPYGSVTPSSTHLGNFASNISGGQMYGPGAPLGGAPAAANFNRQHFSPLSLLTPCSSASNGVALNQQDKQLN

SEQ ID NO: 754002 - protein, 706 aa, Homo sapiens
DNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNLFEKLLSKFQNRVISTYHHCCYTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSEFQMYGLATLERRRKRYTLES

SEQ ID NO: 754003 - protein, 968 aa, Homo sapiens; identical to SEQ ID NO: 753996

SEQ ID NO: 754004 - protein, 425 aa, Homo sapiens
DNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNLFEKLLSKFQNRVISTYHHCCYTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSILMYSRVQSSILS

SEQ ID NO: 754005 - protein, 472 aa, Homo sapiens
MQTDTILYGDLEPLEQQKQQIINEEGTELFSYKGNDVEYFISSSSPSGLYQLDLLSTEKDTHFKVYATTTPESDQPYPELPYDPRVDVTSLGRTTVTLAWKPSPTASLLKQPIQYCVVINKEHNFKSLCAVEAKLSADDAFMMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKVLCKYFHSQNLQKAVTTETIKGLQPGKSYLLDVYVIGHGGHSVKYQSKVVKTRKFC

SEQ ID NO: 754006 - protein, 701 aa, Homo sapiens
SPRQPRGSLRHPPAAQPPHAPCSLKGPPAASRRCPGIPQPRAAPYSTSQQLRRPRAARPRPPLKFAVPTAKLGHFSGLNFSLLSASVPALQASRSWILVLSILAGSGDVDYFAHHTTGRDFFLFSLRKTDLFKDGAAPLVPAVAPVSTQLKDPEVTHPGWELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGLYQLDLLSTEKDTHFKVYATTTPESDQPYPELPYDPRVDVTSLGRTTVTLAWKPSPTASLLKQPIQYCVVINKEHNFKSLCAVEAKLSADDAFMMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKVLCKYFHSQNLQKAVTTETIKGLQPGKSYLLDVYVIGHGGHSVKYQSKVVKTRKFC

SEQ ID NO: 754007 - protein, 701 aa, Homo sapiens; identical to SEQ ID NO: 754006

SEQ ID NO: 754008 - protein, 297 aa, Homo sapiens
GGVPKASLFLSRGPLSWAWLGSALRSRRYQDDRLPAAQAARTGAMSSPDKVSVCGAGFDLEGGKKAGSRTASPGAPGAHSHGLDLGVPGSGDGKSESGFTDPEGFSFESESELIEQGRVVLWGREGRPGTPVDDQGDVVDYSFYLADEPAAIVPPPSVQGHPFPEGAAAEGSAENWADAEVGPSGRDVLGHSPGKWQQASAGRLHLCGPGPVRAWKNPERGSKSRWSLRVDPQQPSAKGPTRLPTHDSDSADESSDLPLMKVGICRNEGSQAKPGSPKKRADTSRQASFHCKESYLP

SEQ ID NO: 754009 - protein, 89 aa, Homo sapiens
MVPRLAFILFVLARDYNVTSLGQDLNWKYEAKDYRKTGELKNIGECGRSYKFLSRNQDWNTRYSHPNRPAKYSGIDEMCKAQESGLSPV

SEQ ID NO: 754010 - protein, 74 aa, Homo sapiens
CHAPSSSHTLSSLLPLPPPPSLLSSEGGQVGLPARSGCYISLEFLATSSPELPVLGWVAGTDRTSKVNIGHPFH

SEQ ID NO: 754011 - protein, 107 aa, Homo sapiens [sequence omitted]

SEQ ID NO: 754012 - protein, 192 aa, Homo sapiens
RGGSRCSDMGGSARLTSRWGSGFSRDGGCASERGAGSRGAGGSARAGSRYGCGSSRGGSRGYSGSRSGPGYSASRRRTGDKLMNATLRGSAIPTVLALRFCSSRRSLLRRAACLPALPLALCRFSSLHHPQPSPPAPRDGCSACLQLPTPHPTTTTVQLWTSSVMCSLSLYENLFRTQTQARTVGSLGLRTH

SEQ ID NO: 754013 - protein, 154 aa, Homo sapiens
RGGSRCSDMGGSARLTSRWGSGFSRDGGCASERGAGSRGAGGSARAGSRYGCGSSRGGSRGYSGSRSGPGYSASRRRTGDKLMNATLRGSAIPTVLALRFCSSRRSLLRRAACLPALPLALCRFSSLHHPQPSPPAPRFAEQLSELGRSSQQRG

SEQ ID NO: 754014 - protein, 138 aa, Homo sapiens
RGGSRCSDMGGSARLTSRWGSGFSRDGGCASERGAGSRGAGGSARAGSRYGCGSSRGGSRGYSGSRSGPGYSASRRRTGDKLMNATLRGSAIPTVLALRFCSSRRSLLRRAACLPALPLALCRFSSLHHPQPSPPAPR

SEQ ID NO: 754015 - protein, 150 aa, Homo sapiens
MEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 754016 - protein, 150 aa, Homo sapiens; identical to SEQ ID NO: 754015

SEQ ID NO: 754017 - protein, 473 aa, Homo sapiens
AAGPVSGGSVGRQTRERLRLVQGSCGLAALASAVVPARMPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGLSAHTHVELPYYSKFILIAAYLASYNPARTDKRFFLKHHGKIKKTNFLKKHEKTSNHLLGPKPFPLDRLLAILYSIVDSRVAPTANIFSQITSLVTLQLLTLVGHDDQLDGPKYKCTVSLDFIRAIARTVNFDIIKYLYDFL

SEQ ID NO: 754018 - protein, 473 aa, Homo sapiens; identical to SEQ ID NO: 754017

SEQ ID NO: 754019 - protein, 303 aa, Homo sapiens
MEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGLSAHTHVELPYYSKFILIAAYLASYNPARTDKRFFLKHHGKIKKTNFLKKHEKTSNHLLGPKPFPLDRLLAILYSIVDSRVAPTANIFSQITSLVTLQLLTLVGHDDQLDGPKYKCTVSLDFIRAIARTVNFDIIKYLYDFL

SEQ ID NO: 754020 - protein, 429 aa, Homo sapiens
IADLQEDPQRYSQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGLSAHTHVELPYYSKFILIAAYLASYNPARTDKRFFLKHHGKIKKTNFLKKHEKTSNHLLGPKPFPLDRLLAILYSIVDSRVAPTANIFSQITSLVTLQLLTLVGHDDQLDGPKYKCTVSLDFIRAIARTVNFDIIKYLYDFL

SEQ ID NO: 754021 - protein, 490 aa, Homo sapiens
MAGLRGYTPKFLKKKTPFSGPVRRGSVGRQTRERLRLVQGSCGLAALASAVVPARMPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGLSAHTHVELPYYSKFILIAAYLASYNPARTDKRFFLKHHGKIKKTNFLKKHEKTSNHLLGPKPFPLDRLLAILYSIVDSRVAPTANIFSQITSLVTLQLLTLVGHDDQLDGPKYKCTVSLDFIRAIARTVNFDIIKYLYDFL

SEQ ID NO: 754022 - protein, 362 aa, Homo sapiens
AAGPVSGGSVGRQTRERLRLVQGSCGLAALASAVVPARMPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGIRGSIETVTGDTSSANYQDTKVNTKEHSVRK

SEQ ID NO: 754023 - protein, 337 aa, Homo sapiens
AAGPVSGGSVGRQTRERLRLVQGSCGLAALASAVVPARMPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISRINYKDGASSELDRDLPGRCPHGGI

SEQ ID NO: 754024 - protein, 921 aa, Homo sapiens
MACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 754025 - protein, 90 aa, Homo sapiens
CLAVARAVLSTLHSHGAGPSPDNWTRVSHRTRTGTKSTLPISETGGGTPELRCGKHQAVGTSPQRAAAQDSEQESAGMEGRDTHRLPRAL

SEQ ID NO: 754026 - protein, 133 aa, Homo sapiens
DAVTRLKVFGEFADLEGIHGHPGEASVVTDDPRQGVLLQLTPLCILKTWLFSHQNQSPSRRAFICFPMRQANRGPVRALGRKFSAKPPSQTSMLSGCLYKSRILSRRSSWRWLCSVSGVSGEAAPDSLHSGIL

SEQ ID NO: 754027 - protein, 917 aa, Homo sapiens
MACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWRVLGWKAGILTGCREPSEGKVAGHCRTASCSQNHRTTLFQTQANPKSAGRLFSQHG

SEQ ID NO: 754028 - protein, 166 aa, Homo sapiens [sequence omitted]

SEQ ID NO: 754029 - protein, 202 aa, Homo sapiens
MACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVGTQNATILD

SEQ ID NO: 754030 - protein, 479 aa, Homo sapiens
MACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPSHHPAEPSSASQ

SEQ ID NO: 754031 - protein, 864 aa, Homo sapiens
MACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 754032 - protein, 921 aa, Homo sapiens; identical to SEQ ID NO: 754024

SEQ ID NO: 754033 - protein, 203 aa, Homo sapiens
MSTCPHFIDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 754034 - protein, 166 aa, Homo sapiens [sequence omitted]

SEQ ID NO: 754035 - protein, 56 aa, Homo sapiens
PPSISKDDPLAEVGVKEVKTKVNSTLTLECESWAVPPPTIRWYKDGQVSLGPPAQL

SEQ ID NO: 754036 - protein, 430 aa, Homo sapiens
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 754037 - protein, 502 aa, Homo sapiens
LINDIKNKKKIWMQWLIPIVPALWEAKGEDHLSPGVWGCSELCSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSVDTPPLPYHATEASETQSGQPVDATADRHVVLSIPNGDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 754038 - protein, 430 aa, Homo sapiens; identical to SEQ ID NO: 754036

SEQ ID NO: 754039 - protein, 467 aa, Homo sapiens
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSVDTPPLPYHATEASETQSGQPVDATADRHVVLSIPNGDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 754040 - protein, 383 aa, Homo sapiens
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVK

SEQ ID NO: 754041 - protein, 104 aa, Homo sapiens
MCPGKSSPRFLGRLQPIQPPSSFIAIFSYHSFIKTSNNILTSFLTALAGRGRGGGCKALLSATGSPFVSGESLPFPRAYACLLRAVAIRFCHPSPFERLTLIRT

SEQ ID NO: 754042 - protein, 109 aa, Homo sapiens
YREIWPSSKIRHETEACGTRCKGSVLCLGTPFPQYCQKVSKSIWDGISTQYVVAVWSSDLLAFPFYHLHGKGLRQQMWLCHNCHSCGLGWRSCELEDGHTHSTADISHT

SEQ ID NO: 754043 - protein, 489 aa, Homo sapiens
RTAPGSPAGEFCQISGQMGNSRSRVGRSFCSQFLPEEQAEIDQLFDALSSDKNSPNVSSKSFSLKALQNHVGEALPPEMVTRLYDGMRRVDLTGKAKGPSENVSQEQFTASMSHLLKGNSEEKSLMIMKMISATEGPVKAREVQKFTEDLVGSVVHVLSHRQELRGWTGKEAPGPNPRVQVLAAQLLSEMKLQDGKRLLGPQWLDYDCDRAVIEDWVFRVPHVAIFLSVVICKGFLVLCSSLDLTTLVPERQVDQGRGFESILDVLSVMYINAQLPREQRHRWRLLFSSELHGHSFSQLCGHITHRGPCVAVLEDHDKHVFGGFASCSWEVKPQFQGDNRCFLFSICPSMAVYTHTGYNDHYMYLNHGQQTIPNGLGMGGQHNYFGLWVDVDFGKGHSRAKPTCTTYNSPQLSAQENFQFDKMEVWAVGDPSEEQLAKGNKSILDADPEAQALLEISGHSRHSKGSGKSRTMNEEPPEPSWSQDLDSSG

SEQ ID NO: 754044 - protein, 472 aa, Homo sapiens
MGNSRSRVGRSFCSQFLPEEQAEIDQLFDALSSDKNSPNVSSKSFSLKALQNHVGEALPPEMVTRLYDGMRRVDLTGKAKGPSENVSQEQFTASMSHLLKGNSEEKSLMIMKMISATEGPVKAREVQKFTEDLVGSVVHVLSHRQELRGWTGKEAPGPNPRVQVLAAQLLSEMKLQDGKRLLGPQWLDYDCDRAVIEDWVFRVPHVAIFLSVVICKGFLVLCSSLDLTTLVPERQVDQGRGFESILDVLSVMYINAQLPREQRHRWRLLFSSELHGHSFSQLCGHITHRGPCVAVLEDHDKHVFGGFASCSWEVKPQFQGDNRCFLFSICPSMAVYTHTGYNDHYMYLNHGQQTIPNGLGMGGQHNYFGLWVDVDFGKGHSRAKPTCTTYNSPQLSAQENFQFDKMEVWAVGDPSEEQLAKGNKSILDADPEAQALLEISGHSRHSKGSGKSRTMNEEPPEPSWSQDLDSSG

SEQ ID NO: 754045 - protein, 218 aa, Homo sapiens
MTDGDYDYLIKLLALGDSGVGKTTFLYRYTDNKFNPKFITTVGIDFREKRVVYNAQGPNGSSGKAFKVHLQLWDTAGQERFRSLTTAFFRDAMGFLLMFDLTSQQSFLNVRNWMSQLQANAYCENPDIVLIGNKADLPDQREVNERQARELADKYGIPYFETSAATGQNVEKAVETLLDLIMKRMEQCVEKTQIPDTVNGGNSGNLDGEKPPEKKCIC

SEQ ID NO: 754046 - protein, 218 aa, Homo sapiens
MTDGDYDYLIKLLALGDSGVGKTTFLYRYTDNKFNPKFITTVGIDFREKRVVYNAQGPNGSSGKAFKVHLQLWDTAGQERFRSLTTAFFRDAMGFLLMFDLTSQQSFLNVRNWMSQLQANAYCENPDIVLIGNKADLPDQREVNERQARELADKYGCKLSTLGINKFDEACLSLHQWSCSLFCISLHLKRIHNSFLIAYYTKRLREKSSFVKDFGFII

SEQ ID NO: 754047 - protein, 153 aa, Homo sapiens
MWTNFQNYPLCFLGRFRSLTTAFFRDAMGFLLMFDLTSQQSFLNVRNWMSQLQANAYCENPDIVLIGNKADLPDQREVNERQARELADKYGCKLSTLGINKFDEACLSLHQWSCSLFCISLHLKRIHNSFLIAYYTKRLREKSSFVKDFGFII

SEQ ID NO: 754048 - protein, 218 aa, Homo sapiens; identical to SEQ ID NO: 754045

SEQ ID NO: 754049 - protein, 277 aa, Homo sapiens
RAFAVTQEESRQHQYRLSILPPSVRLEADRSNSAIKKWARYFQRLQSGGVVEVPTKTITMTDGDYDYLIKLLALGDSGVGKTTFLYRYTDNKFNPKFITTVGIDFREKRVVYNAQGPNGSSGKAFKVHLQLWDTAGQERFRSLTTAFFRDAMGFLLMFDLTSQQSFLNVRNWMSQLQANAYCENPDIVLIGNKADLPDQREVNERQARELADKYGCKLSTLGINKFDEACLSLHQWSCSLFCISLHLKRIHNSFLIAYYTKRLREKSSFVKDFGFII

SEQ ID NO: 754050 - protein, 218 aa, Homo sapiens; identical to SEQ ID NO: 754046

SEQ ID NO: 754051 - protein, 121 aa, Homo sapiens
SVHLSAKSNSTHLGVHLWLSLCLVSAPLYVHTPCQRAALRVYRAQCDSPAAGDIEELCDDGRCGSPASCLAASGSSLSVLAQGAVPYGGSETGLHSHPGVPSTSARLPFPMKIWVYPGCGL

SEQ ID NO: 754052 - protein, 125 aa, Homo sapiens
GLLLGDVLRKTASEAGPIALLILIEASCAVAGLAVASSIVELCYDSIMTGRLFTTLGFLSLHEALTRYSHLILDFTASRNMPWNTLVSVTNAALLCYIEYKRNTWAIFSTEHKLCLLFSSPVIQV

SEQ ID NO: 754053 - protein, 211 aa, Homo sapiens
SSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYSNLEEKKEEPATPAYTISATELLEKQATPREPELLYQNIAERVKELPSAGLVHYNFCTLPKRQFAPSYESRRQNQDRINKTVLYGTPRKCFVGQSKP

SEQ ID NO: 754054 - protein, 815 aa, Homo sapiens
FEVLWSDSSITSVTKSSSEVTEFISKLCQLYPEENLEKLIPCLAGPDAFYVERNHVDLDSGLRYLASLPSHVLKNDHVRRFLSTSSPPQQLQSPSPGNPSLSKVGTVMGVSGRPVCGVAGIPSSQSGAQHHGQHPAGSAAPLPHCSHAGSAGSALAYRTQMDTSPAILMPSSLQTPQTQEQNGILDWLRKLRLHKYYPVFKQLSMEKFLSLTEEDLNKFESLTMGAKKKLKTQLELEKEKSERRCLNPSAPPLVTSSGVARVPPTSHVGPVQSGRGSHAAELRVEVEQPHHQLPREGSSSEYSSSSSSPMGVQAREESSDSAEENDRRVEIHLESSDKEKPVMLLNHFTSSSARPTAQVLPVQNEASSNPSGHHPLPPQMLSAASHITPIRMLNSVHKPERGSADMKLLSSSVHSLLSLEERNKGSGPRSSMKVDKSFGSAMMDVLPASAPHQPVQVLSGLSESSSMSPTVSFGPRTKVVHASTLDRVLKTAQQPALVVETSTAATGTPSTVLHAARPPIKLLLSSSVPADSAISGQTSCPNNVQISVPPAIINPRTALYTANTKVAFSAMSSMPVGPLQGGFCANSNTASPSSHPSTSFANMATLPSCPAPSSSPALSSVPESSFYSSSGGGGSTGNIPASNPNHHHHHHHQQPPAPPQPAPPPPGCIVCTSCGCSGSCGSSGLTVSYANYFQHPFSGPSVFTFPFLPFSPMCSSGYVSAQQYGGGSTFPVVHAPYSSSGTPDPVLSGQSTFAVPPMQNFMAGTAGVYQTQGLVGSSNGSSHKKSGNLSCYNCGATGHRAQDCKQPSMDFNRPG

SEQ ID NO: 754055 - protein, 832 aa, Homo sapiens
FEVLWSDSSITSVTKSSSEVTEFISKLCQLYPEENLEKLIPCLAGPDAFYVERNHVDLDSGLRYLASLPSHVLKNDHVRRFLSTSSPPQQLQSPSPGNPSLSKVGTVMGVSGRPVCGVAGIPSSQSGAQHHGQHPAGSAAPLPHCSHAGSAGSALAYRTQMDTSPAILMPSSLQTPQTQEQNGILDWLRKLRLHKYYPVFKQLSMEKFLSLTEEDLNKFESLTMGAKKKLKTQLELEKEKSERRCLNPSAPPLVTSSGVARVPPTSHVGPVQSGRGSHAAELRVEVEQPHHQLPREGSSSEYSSSSSSPMGVQAREESSDSAEENDRRVEIHLESSDKEKPVMLLNHFTSSSARPTAQVLPVQNEASSNPSGHHPLPPQMLSAASHITPIRMLNSVHKPERGSADMKLLSSSVHSLLSLEERNKGSGPRSSMKVDKSFGSAMMDVLPASAPHQPVQVLSGLSESSSMSPTVSFGPRTKVVHASTLDRVLKTAQQPALVVETSTAATGTPSTVLHAARPPIKLLLSSSVPADSAISGQTSCPNNVQISVPPAIINPRTALYTANTKVAFSAMSSMPVGPLQGGFCANSNTASPSSHPSTSFANMATLPSCPAPSSSPALSSVPESSFYSSSGGGGSTGNIPASNPNHHHHHHHQQPPAPPQPAPPPPGCIVCTSCGCSGSCGSSGLTVSYANYFQHPFSGPSVFTFPFLPFSPMCSSGYVSAQQYGGGSTFPVVHAPYSSSGTPDPVLSGQSTFAVPPMQNFMAGTAGVYQTQGLVGSSNGSSHKKSGNLSCYNCGATGHRAQDCKQPSMDFNRPGTFRLKYAPPAESLDSTD

SEQ ID NO: 754056 - protein, 832 aa, Homo sapiens; identical to SEQ ID NO: 754055

SEQ ID NO: 754057 - protein, 832 aa, Homo sapiens; identical to SEQ ID NO: 754055

SEQ ID NO: 754058 - protein, 566 aa, Homo sapiens
FEVLWSDSSITSVTKSSSEVTEFISKLCQLYPEENLEKLIPCLAGPDAFYVERNHVDLDSGLRYLASLPSHVLKNDHVRRFLSTSSPPQQLQSPSPGNPSLSKVGTVMGVSGRPVCGVAGIPSSQSGAQHHGQHPAGSAAPLPHCSHAGSAGSALAYRTQMDTSPAILMPSSLQTPQTQEQNGILDWLRKLRLHKYYPVFKQLSMEKFLSLTEEDLNKFESLTMGAKKKLKTQLELEKEKSERRCLNPSAPPLVTSSGVARVPPTSHVGPVQSGRGSHAAELRVEVEQPHHQLPREGSSSEYSSSSSSPMGVQAREESSDSAEENDRRVEIHLESSDKEKPVMLLNHFTSSSARPTAQVLPVQNEASSNPSGHHPLPPQMLSAASHITPIRMLNSVHKPERGSADMKLLSSSVHSLLSLEERNKGSGPRSSMKVDKSFGSAMMDVLPASAPHQPVQVLSGLSESSSMSPTVSFGPRTKVVHASTLDRVLKTAQQPALVVETSTAATGTPSTVLHAARPPIKLLLSSSVPADSAISGQTSCPNNVQISVPPAIISPSNCCCRQSSSC

SEQ ID NO: 754059 - protein, 832 aa, Homo sapiens; identical to SEQ ID NO: 754055

SEQ ID NO: 754060 - protein, 832 aa, Homo sapiens; identical to SEQ ID NO: 754055

SEQ ID NO: 754061 - protein, 845 aa, Homo sapiens
FEVLWSDSSITSVTKSSSEVTEFISKLCQLYPEENLEKLIPCLAGPDAFYVERNHVDLDSGLRYLASLPSHVLKNDHVRRFLSTSSPPQQLQSPSPGNPSLSKVGTVMGVSGRPVCGVAGIPSSQSGAQHHGQHPAGSAAPLPHCSHAGSAGSALAYRTQMDTSPAILMPSSLQTPQTQEQNGILDWLRKLRLHKYYPVFKQLSMEKFLSLTEEDLNKFESLTMGAKKKLKTQLELEKEKSERRCLNPSAPPLVTSSGVARVPPTSHVGPVQSGRGSHAAELRVEVEQPHHQLPREGSSSEYSSSSSSPMGVQAREESSDSAEENDRRVEIHLESSDKEKPVMLLNHFTSSSARPTAQVLPVQNEASSNPSGHHPLPPQMLSAASHITPIRMLNSVHKPERGSADMKLLSSSVHSLLSLEERNKGSGPRSSMKVDKSFGSAMMDVLPASAPHQPVQVLSGLSESSSMSPTVSFGPRTKVVHASTLDRVLKTAQQPALVVETSTAATGTPSTVLHAARPPIKLLLSSSVPADSAISGQTSCPNNVQISVPPAIINPRTALYTANTKVAFSAMSSMPVGPLQGGFCANSNTASPSSHPSTSFANMATLPSCPAPSSSPALSSVPESSFYSSSGGGGSTGNIPASNPNHHHHHHHQQPPAPPQPAPPPPGCIVCTSCGCSGSCGSSGLTVSYANYFQHPFSGPSVFTFPFLPFSPMCSSGYVSAQQYGGGSTFPVVHAPYSSSGTPDPVLSGQSTFAVPPMQNFMAGTAGVYQTQGLVGSSNGSSHKKSGNLSCYNCGATGHRAQDCKQPSMDFNRPGKRAPWPRPPGSRRTSAHKCLVFMKSKLLSL

SEQ ID NO: 754062 - protein, 68 aa, Homo sapiens
GAARAGSWVGWGTGAPAPPAPAGLVLHIPASPSSRPHSQAPSQLPRAGRAALISKMLLKAHGHDCTPH

SEQ ID NO: 754063 - protein, 68 aa, Homo sapiens; identical to SEQ ID NO: 754062

SEQ ID NO: 754064 - protein, 68 aa, Homo sapiens; identical to SEQ ID NO: 754062

SEQ ID NO: 754065 - protein, 425 aa, Homo sapiens
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRGRAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 754066 - protein, 336 aa, Homo sapiens
MCRKVPRTERACRRSVGFLVKHLARIGAHYSSSWSCKAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRGRAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 754067 - protein, 52 aa, Homo sapiens
MYWCTYCMEAWLSSQQLVLHRNMRPCIFQMFSLSRLFTMESTTSCTHSCCSS

SEQ ID NO: 754068 - protein, 98 aa, Homo sapiens
GGLGKLRPRCRRVSGLEGSGSQRLRWPQKEAAGAGGEEGLGPRSPSPGGAGGGRGRRDSPRRSDTPAFPSWDHDPGGGRRRRRRHRGRDRAAGGKKKA

SEQ ID NO: 754069 - protein, 128 aa, Homo sapiens
MAAKEPLCSAVSVIRALRTPRVRIDTIDRNGSEEAVMVYHASDVRILAAASGPSVEMMESLKELGLAPCGRHQLSLAAAPFSLCLGFTSEESARKSCPITSVVPILHHQNVSKSERYSCHFVFRFFSR

SEQ ID NO: 754070 - protein, 622 aa, Homo sapiens
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPVEYPLQLLHSPPAPVVKRPGAMATHHPLQEPSQPLNLTAKPKAPELPNTSSSPSLKMSSCVPRPPSHGGPTRDLQSSPPSLPLGFLGEGDAVTKAIQDARQLLHSHSGALDGSPNTPFRKDLISLDSSPAKERLEDGCVHPLEEAMLSCDMDGSRHFPESRNSSHIKRPMNAFMVWAKDERRKILQAFPDMHNSSISKILGSRWKSMTNQEKQPYYEEQARLSRQHLEKYPDYKYKPRPKRTCIVEGKRLRVGEYKALMRTRRQDARQSYVIPPQAGQVQMSSSDVLYPRAAGMPLAQPLVEHYVPRSLDPNMPVIVNTCSLREEGEGTDDRHSVADGEMYRYSEDEDSEGEEKSDGELVVLTD

SEQ ID NO: 754071 - protein, 622 aa, Homo sapiens; identical to SEQ ID NO: 754070

SEQ ID NO: 754072 - protein, 119 aa, Homo sapiens
IPAFPPSHQPLPVTPDSQLALPIQPIPCKPGTQESLAEKELQLLVMIHQLSTLRDQLLTAHSEQKNMAAMLFEKQQQQMELARQQQEQIAKQQQQLIQQQHKINLLQQQISLLLASVSP

SEQ ID NO: 754073 - protein, 259 aa, Homo sapiens
MCIVVPVYFVRGVGYSSTLCGHSLAKERLEDGCVHPLEEAMLSCDMDGSRHFPESRNSSHIKRPMNAFMVWAKDERRKILQAFPDMHNSSISKILGSRWKSMTNQEKQPYYEEQARLSRQHLEKYPDYKYKPRPKRTCIVEGKRLRVGEYKALMRTRRQDARQSYVIPPQAGQVQMSSSDVLYPRAAGMPLAQPLVEHYVPRSLDPNMPVIVNTCSLREEGEGTDDRHSVADGEMYRYSEDEDSEGEEKSDGELVVLTD

SEQ ID NO: 754074 - protein, 195 aa, Homo sapiens [sequence omitted]

SEQ ID NO: 754075 - protein, 622 aa, Homo sapiens; identical to SEQ ID NO: 754070

SEQ ID NO: 754076 - protein, 251 aa, Homo sapiens
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVSLMVGATPHL

SEQ ID NO: 754077 - protein, 164 aa, Homo sapiens
EENWPSSTHPHTPSSRPPQPLRRQMSLWTPTSLNLIPSKKLIPLLDPLGTKIPITFKSALIPLPCFWWGEADCSIKSRCLSLVRLLAAFSLSLPVNTGPTAVRTPLSQRPSFGERDWEGTRFKPHLTTLFPTTSYATDDDIVFEDFARLRLKGMKDDDYDDQLC

SEQ ID NO: 754078 - protein, 220 aa, Homo sapiens
MLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELPPFLQEETLWGQGRFFVSEHKEENKSFTK

SEQ ID NO: 754079 - protein, 89 aa, Homo sapiens
MAINCVFTRGRSHGVAVRQAVRNPGSSGMRTSGEKWLDTAAASKLLLSTSHQHLPLSLSLPPFLQEETLWGQGRFFVSEHKEENKSFTK

SEQ ID NO: 754080 - protein, 409 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754081 - protein, 477 aa, Homo sapiens
ANGPACLLERAGSAAARAIRLTHLAPVPQDQSGAGREGEEARARRARVRIGAGRSRDLGSGRGGCERAANRAGGGRAHHGGETRDQLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754082 - protein, 498 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSGRRWGLEGGLRGGRYCTGGSWCDLSPGHFPVRETHQGSKNLGCSRMIRGASVFTASVGSMGEATPRGLELWCGGGLCSIQSCLTPSHPTVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754083 - protein, 385 aa, Homo sapiens
MLLREEQRLLVPGDWGSGAPDHSSHPPLPVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754084 - protein, 207 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKE

SEQ ID NO: 754085 - protein, 378 aa, Homo sapiens
TQASRGRVLMAGRGGCERAANRAGGGRAHHGGETRDQLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754086 - protein, 409 aa, Homo sapiens; identical to SEQ ID NO: 754080

SEQ ID NO: 754087 - protein, 133 aa, Homo sapiens
GRVGRPTRRRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754088 - protein, 442 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSGRRWGLEGGLRGGRYCTGGSWCDLSPGHFPVRETHQGSKNLGCSRMIRGASVFTASVGSMGGPRHGVWSCGVVVAVCSIQSCLTPSHPTVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLTDPSLQTPW

SEQ ID NO: 754089 - protein, 200 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPRSDEWVKAAGCQCRAMLQCAFVRTANNDDEGTLKPRGKKATKRENGAARMANNARERLRVTRHTNEAFQKSSAAWMQAPPQECHAPNQAPDPPQAESASSVMEAARSEKGN

SEQ ID NO: 754090 - protein, 101 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPREGGGGRWGGGT

SEQ ID NO: 754091 - protein, 117 aa, Homo sapiens [sequence omitted]

SEQ ID NO: 754092 - protein, 141 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPRRWRKEQVRVTKTWRSCRYIRAPEVPTPFYMRQYSEQVCHCVRHAWSQVPDG

SEQ ID NO: 754093 - protein, 109 aa, Homo sapiens
MGEKPGTSGVSLSVLLRVFKKSSPNCKLTVYLGKRDFVDHLDKVDPVDGVVLVDPDYLKDRKVFVTLTCAFRYGREDLDVLGLSFRKDLFIATYQAFPREGGGGRWGGG

SEQ ID NO: 754094 - protein, 409 aa, Homo sapiens; identical to SEQ ID NO: 754080

SEQ ID NO: 754095 - protein, 421 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAPTPTPPPPVPPAAPETDVPVDTNLIEFDTNYATDDDIVFEDFARLRLKGMKDDDYDDQLC

SEQ ID NO: 754096 - protein, 394 aa, Homo sapiens
MPQLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754097 - protein, 408 aa, Homo sapiens
TQASRGRVLIGRARRLRASREPSGRRARAPWGRNPGPDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754098 - protein, 313 aa, Homo sapiens
SGSKEFGTRLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754099 - protein, 298 aa, Homo sapiens
MTPSPQKLYYHGEPLNVNVHVTNNSTKTVKKIKVSGRRWGLEGGLRGGRYCTGGSWCDLSPGHFPVRETHQGSKNLGCSRMIRGASVFTASVGSMGEATPRGLELWCGGGLCSIQSCLTPSHPTVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 754100 - protein, 237 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELPPFLQEETLWGQGRFFVSEHKEENKSFTK

SEQ ID NO: 754101 - protein, 203 aa, Homo sapiens
SQWPRVSAEERAGSAAARAIRLTHLAPVPQDQSGAGREGEEARARRARVRIGAGRSRDLGSGRGGCERAANRAGGGRAHHGGETRDQLTVYLGKRDFVDHLDKVDPVDGVVLVDPDYLKDRKVFVTLTCAFRYGREDLDVLGLSFRKDLFIATYQAFPRRWRKEQVRVKRGGGGGGQLGWETDLAGGNGGPRKDGGIGATFRH

SEQ ID NO: 754102 - protein, 373 aa, Homo sapiens
LRLVEAGCYSAGRGGCERAANRAGGGRAHHGGETRDQIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVSCLCSNAPQRPTDNIPDSPEPSDGREDTHDPMGNSANPRRQLRQTPHNAPRKEAPSGGYEDTMAPDKPQTTGAQQDSRNKERTQTTATANEETETSNAPARRHATTRDGHHKKPQAQ

SEQ ID NO: 754103 - protein, 368 aa, Homo sapiens
LEFSGRCILEADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754104 - protein, 246 aa, Homo sapiens
WLLGTFSEDCACPGCGMAVTVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754105 - protein, 456 aa, Homo sapiens
FFFPGWARAQLDWARRAAAAAPAAGGGGRARAGAGRRAGGRGRRGAGSQASGPRSNHPSRRSTRSSGPGPANAAAGMLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754106 - protein, 456 aa, Homo sapiens; identical to SEQ ID NO: 754105

SEQ ID NO: 754107 - protein, 380 aa, Homo sapiens
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754108 - protein, 456 aa, Homo sapiens; identical to SEQ ID NO: 754105

SEQ ID NO: 754109 - protein, 456 aa, Homo sapiens; identical to SEQ ID NO: 754105

SEQ ID NO: 754110 - protein, 456 aa, Homo sapiens; identical to SEQ ID NO: 754105

SEQ ID NO: 754111 - protein, 380 aa, Homo sapiens; identical to SEQ ID NO: 754107

SEQ ID NO: 754112 - protein, 380 aa, Homo sapiens; identical to SEQ ID NO: 754107

SEQ ID NO: 754113 - protein, 450 aa, Homo sapiens
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLEAGFLKSRDPGAGSSVPLVFFGREVRGGNLEDDIPGTKEEGTESVLLTGVYICMYSRESGAHDDGWGLSMQSAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754114 - protein, 456 aa, Homo sapiens; identical to SEQ ID NO: 754105

SEQ ID NO: 754115 - protein, 151 aa, Homo sapiens
MYSRESGAHDDGWGLSMQSAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754116 - protein, 456 aa, Homo sapiens; identical to SEQ ID NO: 754105

SEQ ID NO: 754117 - protein, 456 aa, Homo sapiens; identical to SEQ ID NO: 754105

SEQ ID NO: 754118 - protein, 117 aa, Homo sapiens
HCKGRRTSRITPEWYHCPYWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754119 - protein, 456 aa, Homo sapiens; identical to SEQ ID NO: 754105

SEQ ID NO: 754120 - protein, 392 aa, Homo sapiens
FFFPGWARAQLDWARRAAAAAPAAGGGGRARAGAGRRAGGRGRRGAGSQASGPRSNHPSRRSTRSSGPGPANAAAGMLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFRLVYSVLSSLHDVTQYI

SEQ ID NO: 754121 - protein, 67 aa, Homo sapiens
GNTEKKEQKTQAGTGPECPGQASGPRSNHPSRRSTRSSGPGPANAAAGYSLLMPSPLPLTQDAPDLV

SEQ ID NO: 754122 - protein, 398 aa, Homo sapiens
FFFPGWARAQLDWARRAAAAAPAAGGGGRARAGAGRRAGGRGRRGAGSQASGPRSNHPSRRSTRSSGPGPANAAAGYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754123 - protein, 446 aa, Homo sapiens
SGWYPSGISSTTAAGGGGRARAGAGRRAGGRGRRGAGSQASGPRSNHPSRRSTRSSGPGPANAAAGMLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754124 - protein, 428 aa, Homo sapiens
GNTEKKEQKTQAGTGPECPGQASGPRSNHPSRRSTRSSGPGPANAAAGMLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754125 - protein, 456 aa, Homo sapiens; identical to SEQ ID NO: 754105

SEQ ID NO: 754126 - protein, 380 aa, Homo sapiens; identical to SEQ ID NO: 754107

SEQ ID NO: 754127 - protein, 230 aa, Homo sapiens
MAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754128 - protein, 240 aa, Homo sapiens
WEEAAAWGGAKSRPLANGHPILNNNHRKNDWTISTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754129 - protein, 456 aa, Homo sapiens; identical to SEQ ID NO: 754105

SEQ ID NO: 754130 - protein, 135 aa, Homo sapiens
ETPVFICATAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 754131 - protein, 456 aa, Homo sapiens; identical to SEQ ID NO: 754105

SEQ ID NO: 754132 - protein, 456 aa, Homo sapiens; identical to SEQ ID NO: 754105

SEQ ID NO: 754133 - protein, 359 aa, Homo sapiens
FFFPGWARAQLDWARRAAAAAPAAGGGGRARAGAGRRAGGRGRRGAGSQASGPRSNHPSRRSTRSSGPGPANAAAGMLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFW

SEQ ID NO: 754134 - protein, 316 aa, Homo sapiens
SDAISQRRRRGSRFRGSSAAVAAANRPDASSLAGLPLELTKAGSAVQAAAATGPAAGQLPGTRVAGFLDEVMKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKVDLFKKSLLLIPIHLEVHWSLITVTLSNRIISFYDSQGIHFKFCVENIRKYLLTEAREKNRPEFLQGWQTAVTKCIPQQKNDSDCGVFVLQYCKCLALEQPFQFSQEDMPRVRKRIYKELCECRLMD

SEQ ID NO: 754135 - protein, 831 aa, Homo sapiens
GRDKPAPASRQPLQRKLGGCGRGEQAGRLVAGGASLGADEGGVRGPGCCRDGAGGGAAARNEGSSCIQISLCIRKMKKQRKILWRKGIHLAFSEKWNTGFGGFKKFYFHQHLCILKAKLGRPVTWNRQLRHFQGRKKALQIQKTWIKDEPLCAKTKFNVATQNVSTLSSKVKRKDAKHFISSSKTLLRLQAEKLLSSAKNSDHEYCREKNLLKAVTDFPSNSALGQANGHRPRTDPQPSDFPMKFNGESQSPGESGTIVVTLNNHKRKGFCYGCCQGPEHHRNGGPLIPKKFQLNQHRRIKLSPLMMYEKLSMIRFRYRILRSQHFRTKSKVCKLRKAQRSWVQKVTGDHQETRRENGEGGSCSPFPSPEPKDPSCRHQPYFPDMDSSAVVKGTNSHVPDCHTKGSSFLGKELSLDEAFPDQQNGSATNAWDQSSCSSPKWECTELIHDIPLPEHRSNTMFISETEREIMTLGQENQTSSVSDDRVKLSVSGADTSVSSVDGPVSQKAVQNENSYQMEEDGSLKQSILSSELLDHPYCKSPLEAPLVCSGLKLENQVGGGKNSQKASPVDDEQLSVCLSGFLDEVMKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKVDLFKKSLLLIPIHLEVHWSLITVTLSNRIISFYDSQGIHFKFCVENIRKYLLTEAREKNRPEFLQGWQTAVTKCIPQQKNDSDCGVFVLQYCKCLALEQPFQFSQEDMPRVRKRIYKELCGWREEGR

SEQ ID NO: 754136 - protein, 806 aa, Homo sapiens
GRDKPAPASRQPLQRKLGGCGRGEQAGRLVAGGASLGADEGGVRGPGCCRDGAGGGAAARNEGSSCIQISLCIRKMKKQRKILWRKGIHLAFSEKWNTGFGGFKKFYFHQHLCILKAKLGRPVTWNRQLRHFQGRKKALQIQKTWIKDEPLCAKTKFNVATQNVSTLSSKVKRKDAKHFISSSKTLLRLQAEKLLSSAKNSDHEYCREKNLLKAVTDFPSNSALGQANGHRPRTDPQPSDFPMKFNGESQSPGESGTIVVTLNNHKRKGFCYGCCQGPEHHRNGGPLIPKKFQLNQHRRIKLSPLMMYEKLSMIRFRYRILRSQHFRTKSKVCKLRKAQRSWVQKVTGDHQETRRENGEGGSCSPFPSPEPKDPSCRHQPYFPDMDSSAVVKGTNSHVPDCHTKGSSFLGKELSLDEAFPDQQNGSATNAWDQSSCSSPKWECTELIHDIPLPEHRSNTMFISETEREIMTLGQENQTSSVSDDRVKLSVSGADTSVSSVDGPVSQKAVQNENSYQMEEDGSLKQSILSSELLDHPYCKSPLEAPLVCSGLKLENQVGGGKNSQKASPVDDEQLSVCLSGFLDEVMKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKVDLFKKSLLLIPIHLEVHWSLITVTLSNRIISFYDSQGIHFKFCVENIRKYLLTEAREKNRPEFLQGWQTAVTKCIPQQKNDSDCGVFVLQVKKHLLFGTYNV

SEQ ID NO: 754137 - protein, 830 aa, Homo sapiens
GRDKPAPASRQPLQRKLGGCGRGEQAGRLVAGGASLGADEGGVRGPGCCRDGAGGGAAARNEGSSCIQISLCIRKMKKQRKILWRKGIHLAFSEKWNTGFGGFKKFYFHQHLCILKAKLGRPVTWNRQLRHFQGRKKALQIQKTWIKDEPLCAKTKFNVATQNVSTLSSKVKRKDAKHFISSSKTLLRLQAEKLLSSAKNSDHEYCREKNLLKAVTDFPSNSALGQANGHRPRTDPQPSDFPMKFNGESQSPGESGTIVVTLNNHKRKGFCYGCCQGPEHHRNGGPLIPKKFQLNQHRRIKLSPLMMYEKLSMIRFRYRILRSQHFRTKSKVCKLRKAQRSWVQKVTGDHQETRRENGEGGSCSPFPSPEPKDPSCRHQPYFPDMDSSAVVKGTNSHVPDCHTKGSSFLGKELSLDEAFPDQQNGSATNAWDQSSCSSPKWECTELIHDIPLPEHRSNTMFISETEREIMTLGQENQTSSVSDDRVKLSVSGADTSVSSVDGPVSQKAVQNENSYQMEEDGSLKQSILSSELLDHPYCKSPLEAPLVCSGLKLENQVGGGKNSQKASPVDDEQLSVCLSGFLDEVMKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKVDLFKKSLLLIPIHLEVHWSLITVTLSNRIISFYDSQGIHFKFCVENIRKYLLTEAREKNRPEFLQGWQTAVTKCIPQQKNDSDCGVFVLQYCKCLALEQPFQFSQEDMPRVRKRIYKELCECRLMD

SEQ ID NO: 754138 - protein, 802 aa, Homo sapiens
GRDKPAPASRQPLQRKLGGCGRGEQAGRLVAGGASLGADEGGVRGPGCCRDGAGGGAAARNEGSSCIQISLCIRKMKKQRKILWRKGIHLAFSEKWNTGFGGFKKFYFHQHLCILKAKLGRPVTWNRQLRHFQGRKKALQIQKTWIKDEPLCAKTKFNVATQNVSTLSSKVKRKDAKHFISSSKTLLRLQAEKLLSSAKNSDHEYCREKNLLKAVTDFPSNSALGQANGHRPRTDPQPSDFPMKFNGESQSPGESGTIVVTLNNHKRKGFCYGCCQGPEHHRNGGPLIPKKFQLNQHRRIKLSPLMMYEKLSMIRFRYRILRSQHFRTKSKVCKLRKAQRSWVQKVTGDHQETRRENGEGGSCSPFPSPEPKDPSCRHQPYFPDMDSSAVVKGTNSHVPDCHTKGSSFLGKELSLDEAFPDQQNGSATNAWDQSSCSSPKWECTELIHDIPLPEHRSNTMFISETEREIMTLGQENQTSSVSDDRVKLSVSGADTSVSSVDGPVSQKAVQNENSYQMEEDGSLKQSILSSELLDHPYCKSPLEAPLVCSGLKLENQVGGGKNSQKASPVDDEQLSVCLSGFLDEVMKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKVDLFKKSLLLIPIHLEVHWSLITVTLSNRIISFYDSQGIHFKFCVECIPQQKNDSDCGVFVLQYCKCLALEQPFQFSQEDMPRVRKRIYKELCECRLMD

SEQ ID NO: 754139 - protein, 812 aa, Homo sapiens
GRDKPAPASRQPLQRKLGGCGRGEQAGRLVAGGASLGADEGGVRGPGCCRDGAGGGAAARNEGSSCIQISLCIRKMKKQRKILWRKGIHLAFSEKWNTGFGGFKKFYFHQHLCILKAKLGRPVTWNRQLRHFQGRKKALQIQKTWIKDEPLCAKTKFNVATQNVSTLSSKVKRKDAKHFISSSKTLLRLQAEKLLSSAKNSDHEYCREKNLLKAVTDFPSNSALGQANGHRPRTDPQPSDFPMKFNGESQSPGESGTIVVTLNNHKRKGFCYGCCQGPEHHRNGGPLIPKKFQLNQHRRIKLSPLMMYEKLSMIRFRYRILRSQHFRTKSKVCKLRKAQRSWVQKVTGDHQETRRENGEGGSCSPFPSPEPKDPSCRHQPYFPDMDSSAVVKGTNSHVPDCHTKGSSFLGKELSLDEAFPDQQNGSATNAWDQSSCSSPKWECTELIHDIPLPEHRSNTMFISETEREIMTLGQENQTSSVSDDRVKLSVSGADTSVSSVDGPVSQKAVQNENSYQMEEDGSLKQSILSSELLDHPYCKSPLEAPLVCSGLKLENQVGGGKNSQKASPVDDEQLSVCLSGFLDEVMKKYGSLVPLSEKEVLGRLKDVFNEDFSNRKPFINREITNYRARHQKCNFRIFYNKHMLDMDDLATLDGQNWLNDQVINMYGELIMDAVPDKVHFFNSFFHRQLVTKGYNGVKRWTKKVDLFKKSLLLIPIHLEVHWSLITVTLSNRIISFYDSQGIHFKFCVENIRKYLLTEAREKNRPEFLQGWQTAVTKCIPQQKNDSDCGVFVLQYCSTPLDAFPFSGSSRTP

SEQ ID NO: 754140 - protein, 131 aa, Homo sapiens
LVRTEPPNRQKVAVLAHRRHSHSCGQLNYRDPHLPTGLAPSKAQDSKAYTSILYGNGPGYVFNSGVRPDVNESESETADLCHAAACTPDNKGTKTTQPPPCLYPKEDQAGLDPETSPIVGHDTPRPRAPPS

SEQ ID NO: 754141 - protein, 639 aa, Homo sapiens
MQGPWVLLLLGLRLQLSLGVIPGNEAPQAVPHTGHPLSQADLISTLPLATEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPRLHHRRRAPSCRVAATAGRDPAAAGGVRCSLSAPLRSYPAPHLRASCPVPRPEPPLPANTHRCPAVGPSPPRDKPASAGAAGPFFPPHPLQGAGAQGALGAEPGTSRTSPQVVL

SEQ ID NO: 754142 - protein, 612 aa, Homo sapiens
MQGPWVLLLLGLRLQLSLGVIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPRLHHRRRAPSCRVAATAGRDPAAAGGVRCSLSAPLRSYPAPHLRASCPVPRPEPPLPANTHRCPAVGPSPPRDKPASAGAAGPFFPPHPLQGAGAQGALGAEPGTSRTSPQVVL

SEQ ID NO: 754143 - protein, 121 aa, Homo sapiens
DSHALELISLRNVCIHTNAQHKVNIFLGPFCLCQGQEVEAGNSSGPQYGRRQGGDGVAHPFSGYLASGRQQGGAGRPSVTDKPAILSSGLWESACSKPVHPSCSPKSWLKVLGWIHWRWAT

SEQ ID NO: 754144 - protein, 116 aa, Homo sapiens
MTSSPVKTVSCSEWSFKGVGTNCKMMYLEGWGLRRIFCCLPEALWQTGSARGGEREASVLFGKLAIKTGKGVLFSKKAGICFRTLSCPLIAVDSSQQHKEMKGKGRMQQAKLTLYL

SEQ ID NO: 754145 - protein, 114 aa, Homo sapiens
MRQHRQFMDRTHYLLTFSSSETLLRLLLRIVDRAPKGRTFGDVLQPAKPEYRVGEVAEVIFVGANPKNSVQNQTHQTFLTVEKYEATSTSWQIVCNDASWENSFLLAQGTPGSE

SEQ ID NO: 754146 - protein, 123 aa, Homo sapiens
MCLLLAFAPHQLIRGRPHSCPGLRGGLRRGRCTLLRSPTAGVEAADSEGRVGRNREGCGPGGTHCADGAGARTQLLTSLPALPWKSSRRRSLFSAFLFPSPRVGATVNFRFRRCGSGPEESQL

SEQ ID NO: 754147 - protein, 123 aa, Homo sapiens; identical to SEQ ID NO: 754146

SEQ ID NO: 754148 - protein, 323 aa, Homo sapiens
MGNLLKVLTREIENYPHFFLDFENAQPTEGEREIWNQISAVLQDSESILADLQAYKGAGPEIRDAIQNPNDIQLQEKAWNAVCPLVVRLKRFYEFSIRLEKALQSLLESLTCPPYTPTQHLEREQALAKEFAEILHFTLRFDELKMRNPAIQNDFSYYRRTISRNRINNMHLDIENEVNNEMANRMSLFYAEATPMLKTLSNATMHFVSENKTLPIENTTDCLSTMTSVCKVMLETPEYRSRFTSEETLMFCMRVMVGVIILYDHVHPVGAFCKTSKIDMKGCIKVLKEQAPDSVEGLLNALRFTTKHLNDESTSKQIRAMLQ

SEQ ID NO: 754149 - protein, 94 aa, Homo sapiens
STFYHHWHLNTPLGGLRLVLPTPATTITADTYLHMAPAGLETELPTPSQPPPTPAYTAQDPEDYPITATAVLCQLPRGPRICPPTQLTAATTSI

SEQ ID NO: 754150 - protein, 101 aa, Homo sapiens
MKPISRMDFAHRPLVTDDTFSSFTPHVFLSRFFFFVCLFVLRWSFTLVAQAGVQGDNSRVTGNSASQDQAISPASGSQIAGITGMCHRAQVTRIVCVVEMG

SEQ ID NO: 754151 - protein, 247 aa, Homo sapiens
MNKMGLNNPKKNHSRTMGATGLGFLLPWKQDNLNGTDCQGCNILYFSETTGSMCSELSLNRGLEARRKKDLKDSFLWRYGKVGCISLPLREMTAWINPPQISEIFQGYHQRVHGADALSLQTNSLRSRLSSQCLGQSFLLRTLERAVVSGHLGTSVATFMKKTKPTSSQDPPKSGRGFGTPAVGSTMRIKPPSLLDMSRSGRCYKSPGATTRVRIKTSPQDPPRRVHGIETSGGQVRKRHPVCSTQN

SEQ ID NO: 754152 - protein, 129 aa, Homo sapiens
MPQYSRTALPLSGQPSEAVFPLTRMGITPWACKSYLSSCNCMSKACPQGDGADPGWQTQSGEENAESHPLRDLLQSATILEVHDLEQQSLVGEGFFCWSGVSSHSLRVLSWGCYPVNWVIFSLHPNLGL

SEQ ID NO: 754153 - protein, 79 aa, Homo sapiens
TAPGWEPPDDPDTGSECSHPEVSPSPRFVAAKTQTNQSGKKAPASVVRCATLLHRTPPATQTQTFRTPNSGSPASKATA

SEQ ID NO: 754154 - protein, 1906 aa, Homo sapiens
VSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKVGVTEGSQCTGASVGVFNSHFTEEQNPPRDLKQKTSSPSSFKMHSNSQDKEVTILAEGRRQSQKLPVDFERSFQEEKPLERSDFTGSHSEPSTRANCSNFKEIQISDNHTLISMGRPSSTLGVNRSSSRLGVKEKNVTITPDLPSCIFLEQRELFEQSKAPRADDHVRKHHSPSPQHQDYVAPDLPSCIFLEQRELFEQCKAPYVDHQMRENHSPLPQGQDSIASDLPSPISLEQCQSKAPGVDDQMNKHHFPLPQGQDCVVEKNNQHKPKSHISNINVEAKFNTVVSQSAPNHCTLAASASTPPSNRKALSCVHITLCPKTSSKLDSGTLDERFHSLDAASKARMNSEFNFDLHTVSSRSLEPTSKLLTSKPVAQDQESLGFLGPKSSLDFQVVQPSLPDSNTITQDLKTIPSQNSQIVTSRQIQVNISDFEGHSNPEGTPVFADRLPEKMKTPLSAFSEKLSSDAVTQITTESPEKTLFSSEIFINAEDRGHEIIEPGNQKLRKAPVKFASSSSVQQVTFSRGTDGQPLLLPYKPSGSTKMYYVPQLRQIPPSPDSKSDTTVESSHSGSNDAIAPDFPAQVLGTRDDDLSATVNIKHKEGIYSKRVVTKASLPVGEKPLQNENADASVQVLITGDENLSDKKQQEIHSTRAVTEAAQAKEKESLQKDTADSSAAAAAEHSAQVGDPEMKNLPDTKAITQKEEIHRKKTVPEEAWPNNKESLQINIEESECHSEFENTTRSVFRSAKFYIHHPVHLPSDQDICHESLGKSVFMRHSWKDFFQHHPDKHREHMCLPLPYQNMDKTKTDYTRIKSLSINVNLGNKEVMDTTKSQVRDYPKHNGQISDPQRDQKVTPEQTTQHTVSLNELWNKYRERQRQQRQPELGDRKELSLVDRLDRLAKILQNPITHSLQVSESTHDDSRGERSVKEWSGRQQQRNKLQKKKRFKSLEKSHKNTGELKKSKVLSHHRAGRSNQIKIEQIKFDKYILSKQPGFNYISNTSSDCRPSEESELLTDTTTNILSGTTSTVESDILTQTDREVALHERSSSVSTIDTARLIQAFGHERVCLSPRRIKLYSSITNQQRRYLEKRSKHSKKVLNTGHPLVTSEHTRRRHIQVANHVISSDSISSSASSFLSSNSTFCNKQNVHMLNKGIQAGNLEIVNGAKKHTRDVGITFPTPSSSEAKLEENSDVTSWSEEKREEKMLFTGYPEDRKLKKNKKNSHEGVSWFVPVENVESRSKKENVPNTCGPGISWFEPITKTRPWREPLREQNCQGQHLDGRGYLAGPGREAGRDLLRPFVRATLQESLQFHRPDFISRSGERIKRLKLIVQERKLQSMLQTERDALFNIDRERQGHQNRMCPLPKRVFLAIQKNKPISKKEMIQRSKR

SEQ ID NO: 754155 - protein, 138 aa, Homo sapiens
FLFFFSFQESLQFHRPDFISRSGERIKRLKLIVQERKLQSMLQTERDALFNIDRERQGHQNRMCPLPKRVFLAIQKNKPISKKEMIQRSKRIYEQLPEVQKKREEEKRKSEYKSYRLRAQLYKKRVTNQLLGRKVPWD

SEQ ID NO: 754156 - protein, 1953 aa, Homo sapiens
VSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKVGVTEGSQCTGASVGVFNSHFTEEQNPPRDLKQKTSSPSSFKMHSNSQDKEVTILAEGRRQSQKLPVDFERSFQEEKPLERSDFTGSHSEPSTRANCSNFKEIQISDNHTLISMGRPSSTLGVNRSSSRLGVKEKNVTITPDLPSCIFLEQRELFEQSKAPRADDHVRKHHSPSPQHQDYVAPDLPSCIFLEQRELFEQCKAPYVDHQMRENHSPLPQGQDSIASDLPSPISLEQCQSKAPGVDDQMNKHHFPLPQGQDCVVEKNNQHKPKSHISNINVEAKFNTVVSQSAPNHCTLAASASTPPSNRKALSCVHITLCPKTSSKLDSGTLDERFHSLDAASKARMNSEFNFDLHTVSSRSLEPTSKLLTSKPVAQDQESLGFLGPKSSLDFQVVQPSLPDSNTITQDLKTIPSQNSQIVTSRQIQVNISDFEGHSNPEGTPVFADRLPEKMKTPLSAFSEKLSSDAVTQITTESPEKTLFSSEIFINAEDRGHEIIEPGNQKLRKAPVKFASSSSVQQVTFSRGTDGQPLLLPYKPSGSTKMYYVPQLRQIPPSPDSKSDTTVESSHSGSNDAIAPDFPAQVLGTRDDDLSATVNIKHKEGIYSKRVVTKASLPVGEKPLQNENADASVQVLITGDENLSDKKQQEIHSTRAVTEAAQAKEKESLQKDTADSSAAAAAEHSAQVGDPEMKNLPDTKAITQKEEIHRKKTVPEEAWPNNKESLQINIEESECHSEFENTTRSVFRSAKFYIHHPVHLPSDQDICHESLGKSVFMRHSWKDFFQHHPDKHREHMCLPLPYQNMDKTKTDYTRIKSLSINVNLGNKEVMDTTKSQVRDYPKHNGQISDPQRDQKVTPEQTTQHTVSLNELWNKYRERQRQQRQPELGDRKELSLVDRLDRLAKILQNPITHSLQVSESTHDDSRGERSVKEWSGRQQQRNKLQKKKRFKSLEKSHKNTGELKKSKVLSHHRAGRSNQIKIEQIKFDKYILSKQPGFNYISNTSSDCRPSEESELLTDTTTNILSGTTSTVESDILTQTDREVALHERSSSVSTIDTARLIQAFGHERVCLSPRRIKLYSSITNQQRRYLEKRSKHSKKVLNTGHPLVTSEHTRRRHIQVANHVISSDSISSSASSFLSSNSTFCNKQNVHMLNKGIQAGNLEIVNGAKKHTRDVGITFPTPSSSEAKLEENSDVTSWSEEKREEKMLFTGYPEDRKLKKNKKNSHEGVSWFVPVENVESRSKKENVPNTCGPGISWFEPITKTRPWREPLREQNCQGQHLDGRGYLAGPGREAGRDLLRPFVRATLQESLQFHRPDFISRSGERIKRLKLIVQERKLQSMLQTERDALFNIDRERQGHQNRMCPLPKRVFLAIQKNKPISKKEMIQRSKRIYEQLPEVQKKREEEKRKSEYKSYRLRAQLYKKRVTNQLLGRKVPWD

SEQ ID NO: 754157 - protein, 1953 aa, Homo sapiens; identical to SEQ ID NO: 754156

SEQ ID NO: 754158 - protein, 138 aa, Homo sapiens; identical to SEQ ID NO: 754155

SEQ ID NO: 754159 - protein, 1953 aa, Homo sapiens; identical to SEQ ID NO: 754156

SEQ ID NO: 754160 - protein, 1713 aa, Homo sapiens
VSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKVGVTEGSQCTGASVGVFNSHFTEEQNPPRDLKQKTSSPSSFKMHSNSQDKEVTILAEGRRQSQKLPVDFERSFQEEKPLERSDFTGSHSEPSTRANCSNFKEIQISDNHTLISMGRPSSTLGVNRSSSRLGVKEKNVTITPDLPSCIFLEQRELFEQSKAPRADDHVRKHHSPSPQHQDYVAPDLPSCIFLEQRELFEQCKAPYVDHQMRENHSPLPQGQDSIASDLPSPISLEQCQSKAPGVDDQMNKHHFPLPQGQDCVVEKNNQHKPKSHISNINVEAKFNTVVSQSAPNHCTLAASASTPPSNRKALSCVHITLCPKTSSKLDSGTLDERFHSLDAASKARMNSEFNFDLHTVSSRSLEPTSKLLTSKPVAQDQESLGFLGPKSSLDFQVVQPSLPDSNTITQDLKTIPSQNSQIVTSRQIQVNISDFEGHSNPEGTPVFADRLPEKMKTPLSAFSEKLSSDAVTQITTESPEKTLFSSEIFINAEDRGHEIIEPGNQKLRKAPVKFASSSSVQQVTFSRGTDGQPLLLPYKPSGSTKMYYVPQLRQIPPSPDSKSDTTVESSHSGSNDAIAPDFPAQVLGTRDDDLSATVNIKHKEGIYSKRVVTKASLPVGEKPLQNENADASVQVLITGDENLSDKKQQEIHSTRAVTEAAQAKEKESLQKDTADSSAAAAAEHSAQVGDPEMKNLPDTKAITQKEEIHRKKTVPEEAWPNNKESLQINIEESECHSEFENTTRSVFRSAKFYIHHPVHLPSDQDICHESLGKSVFMRHSWKDFFQHHPDKHREHMCLPLPYQNMDKTKTDYTRIKSLSINVNLGNKEVMDTTKSQVRDYPKHNGQISDPQRDQKVTPEQTTQHTVSLNELWNKYRERQRQQRQPELGDRKELSLVDRLDRLAKILQNPITHSLQVSESTHDDSRGERSVKEWSGRQQQRNKLQKKKRFKSLEKSHKNTGELKKSKVLSHHRAGRSNQIKIEQIKFDKYILSKQPGFNYISNTSSDCRPSEESELLTDTTTNILSGTTSTVESDILTQTDREVALHERSSSVSTIDTARLIQAFGHERVCLSPRRIKLYSSITNQQRRYLEKRSKHSKKVLNTGHPLVTSEHTRRRHIQVANHVISSDSISSSASSFLSSNSTFCNKQNVHMLNKGIQAGNLEIVNGAKKHTRDVGITFPTPSSSEAKLELGKLSQRR

SEQ ID NO: 754161 - protein, 111 aa, Homo sapiens
ERRGVEFVHVYCVDNILVRLADPVFIGFCVLQGADCGAKVVEKAYPEEPVGVVCQVDGVPQVVEYSEISPETAQLRASDGSLLYNAGNICNHFFTRGFLKAVTRCAAAGGC

SEQ ID NO: 754162 - protein, 265 aa, Homo sapiens
ERRGVEFVHVYCVDNILVRLADPVFIGFCVLQGADCGAKVVEKAYPEEPVGVVCQVDGVPQVVEYSEISPETAQLRASDGSLLYNAGNICNHFFTRGFLKAVTREFEPLLKPHVAVKKVPYVDEEGNLVKPLKPNGIKMEKFVFDVFRFAKNFAALEVLREEEFSPLKNAEPADRDSPRTARQALLTQHYRWALRAGARFLDAHGAWLPELPSLPPNGDPPAICEISPLVSYSGEGLEVYLQGREFQSPLILDEDQAREPQLQES

SEQ ID NO: 754163 - protein, 265 aa, Homo sapiens; identical to SEQ ID NO: 754162

SEQ ID NO: 754164 - protein, 121 aa, Homo sapiens [sequence omitted]

SEQ ID NO: 754165 - protein, 32 aa, Homo sapiens
MEWKGGLPLEFGYPLLTSSLWSYRQAVLLKSH

SEQ ID NO: 754166 - protein, 222 aa, Homo sapiens
AECLLRRCIDKAETVQRIIYIATVEAFHVAKMAFRHFKIHVRKSLTPSYVGSNDFENAVLDYVICHLDLYDSQSSVNDVIRAMNVNPKISFPPVVDFCLLSDFIQEICCIAFAMQALEPPLDIAYGADGEVFNDCKYRRSYDSDFTAPLVLYHVWPALMENDCVIMKGEAVTRRGAFWNSVRSVSRCRSRSLSPICPRSQIGLNTMSRSRSPSPIRCGLPRF

SEQ ID NO: 754167 - protein, 206 aa, Homo sapiens
AECLLRRCIDKAETVQRIIYIATVEAFHVAKMAFRHFKIHVRKSLTPSYVGSNDFENAVLDYVICHLDLYDSQSSVNDVIRAMNVNPKISFPPVVDFCLLSDFIQEICCIAFAMQALEPPLDIAYGADGEVFNDCKYRRSYDSDFTAPLVLYHVWPALMENDCVIMKGEAVTRRGAFVRWPCIVTIHPKCLIHKFENIYKPRDSIK

SEQ ID NO: 754168 - protein, 522 aa, Homo sapiens
MAVNKGLTLLDGDLPEQENVLQRVLQLPVVSGTCECFQKTYTSTKEAHPLVASVCNAYEKGVQSASSLAAWSMEPVVRRLSTQFTAANELACRGLDHLEEKIPALQYPPEKIASELKDTISTRLRSARNSISVPIASTSDKVLGAALAGCELAWGVARDTAEFAANTRAGRLASGGADLALGSIEKVVEYLLPADKEESAPAPGHQQAQKSPKAKPSLLSRVGALTNTLSRYTVQTMARALEQGHTVAMWIPGVVPLSSLAQWGASVAMQAVSRRRSEVRVPWLHSLAAAQEEDHEDQTDTEGEDTEEEEELETEENKFSEVAALPGPRGLLGGVAHTLQKTLQTTISAVTWAPAAVLGMAGRVLHLTPAPAVSSTKGRAMSLSDALKGVTDNVVDTVVHYVPLPRLSLMEPESEFRDIDNPPAEVERREAERRASGAPSAGPEPAPRLAQPRRSLRSAQSPGAPPGPGLEDEVATPAAPRPGFPAVPREKPKRRVSDSFFRPSVMEPIVGRTHYSQLRKKS

SEQ ID NO: 754169 - protein, 68 aa, Homo sapiens
MAIDCGLTLLAAHCSSGAMSVFTFLPQLGGNRGKDLSSGCGQGSFACILGAPHQRDVGQQFLSAITPG

SEQ ID NO: 754170 - protein, 370 aa, Homo sapiens
KALRAGSRRRVRTPRTESAQTTQHSPLRPLWRLKRDSSPCHPQTRADWGVCPPWGGAAQGLRPGCHLAPRRCLCPGSCCPWHWAEAQWSFLWRGLWGLRTLPTALRLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLENLMDGILLDQQTGSGRISGSGRSVELLRERGPGTRDDLTCGSCQEGRAQPWSLTCCVGLI

SEQ ID NO: 754171 - protein, 736 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGGEWEQALGGGPPPGSQACASSPLPSPSVFSAAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754172 - protein, 688 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754173 - protein, 261 aa, Homo sapiens
MDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754174 - protein, 357 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDVNSSEKLQLQECLWAAMGR

SEQ ID NO: 754175 - protein, 707 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDVNSSEKLQLQECLWADSLGPLKDDVLLLETRGPQDNRSLCALEPSGCTSLPSKASTLWDDDLGALWACPMDKYIHKRWALVWLACLLFAAALSLILLLKKDHAKGERFPAPHSPGGGPEWLWEFSEEKAAAELTGCLRPSPLTGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754176 - protein, 544 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKTCGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754177 - protein, 720 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754178 - protein, 847 aa, Homo sapiens
KALRAGSRRRVRTPRTESAQTTQHSPLRPLWRLKRDSSPCHPQTRADWGVCPPWGGAAQGLRPGCHLAPRRCLCPGSCCPWHWAEAQWSFLWRGLWGLRTLPTALRESGTLGRRGKAQGSVFGSAKPVAWLLSLLPLPELPCLVCLVLMVEEKNGEGARAGSVFLWEGLGIRSPRKRSLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754179 - protein, 847 aa, Homo sapiens
KALRAGSRRRVRTPRTESAQTTQHSPLRPLWRLKRDSSPCHPQTRADWGVCPPWGGAAQGLRPGCHLAPRRCLCPGSCCPWHWAEAQWSFLWRGLWGLRTLPTALRLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTWGGLPLPKSIPTVGRCLCKGRSAISERILEEDSPQARENWWGNFCLPGFLDFGLLLFLLIFSNLLPLFVPQTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754180 - protein, 241 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTW

SEQ ID NO: 754181 - protein, 356 aa, Homo sapiens
MVSSQQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754182 - protein, 127 aa, Homo sapiens
MGCPGPGRTARTTPSAPRSAACCPTSCRAGRPAATWGPASTGCSTRTPYPPFSAPCPSSHCPPNCQTSWGPCSSLAPRVPGGSKRERSKCPGPFSQPWIATSIPRGLPRRDAGWDQGRDLGRGTGLK

SEQ ID NO: 754183 - protein, 375 aa, Homo sapiens
MLEIWRSGHQSLVNIGTPGWCPGFGSVCILQLWDDDLGALWACPMDKYIHKRWALVWLACLLFAAALSLILLLKKDHAKGERFPAPHSPGGGPEWLWEFSEEKAAAELTGCLRPSPLTGWLRLLKQDVRSGGEWEQALGGGPPPGSQACASSPLPSPSVFSAAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754184 - protein, 306 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLKGANIPDQHRYRRIRWPDLPTKMPREPPPQLKRDTTQRETHHGTEDSPVPAHTDRCDAPLYWQHALQ

SEQ ID NO: 754185 - protein, 705 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754186 - protein, 261 aa, Homo sapiens; identical to SEQ ID NO: 754173

SEQ ID NO: 754187 - protein, 261 aa, Homo sapiens; identical to SEQ ID NO: 754173

SEQ ID NO: 754188 - protein, 679 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCHGARPCRRAAWWSCSSLPVRWRCAASGYRMGCPGPGRTARTTPSAPRSAACCPTSCRAGRPAATWGPASTGCSTRTPYPPFSAPCPSSHCPPNCQTSWGPCSSLAPRVPGGSKRERSKCPGPFSQPWIATSIPRGLPRRDAGWDQGRDLGRGTGLK

SEQ ID NO: 754189 - protein, 667 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754190 - protein, 578 aa, Homo sapiens
ISVRGPGCVVHDLGVGRQFALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754191 - protein, 344 aa, Homo sapiens
MLEIWRSGHQSLVNIGTPGWCPGFGSVCILQLWDDDLGALWACPMDKYIHKRWALVWLACLLFAAALSLILLLKKDHAKGERFPAPHSPGGGPEWLWEFSEEKAAAELTGCLRPSPLTGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 754192 - protein, 127 aa, Homo sapiens; identical to SEQ ID NO: 754182

SEQ ID NO: 754193 - protein, 55 aa, Homo sapiens
DNRSLCALEPSGCTSLPSKASTVRTGRPSSTDLSKCISHLASNFHSIHPVPVSGN

SEQ ID NO: 754194 - protein, 517 aa, Homo sapiens
MLRFLAPRLLSLQGRTARYSSAAALPSPILNPDIPYNQLFINNEWQDAVSKKTFPTVNPTTGEVIGHVAEGDRADVDRAVKAAREAFRLGSPWRRMDASERGRLLNLLADLVERDRVYLASLETLDNGKPFQESYALDLDEVIKVYRYFAGWADKWHGKTIPMDGQHFCFTRHEPVGVCGQIIPWNFPLVMQGWKLAPALATGNTVVMKVAEQTPLSALYLASLIKEAGFPPGVVNIITGYGPTAGAAIAQHMDVDKVAFTGSTEVGHLIQKAAGDSNLKRVTLELGGKSPSIVLADADMEHAVEQCHEALFFNMGQCCCAGSRTFVEESIYNEFLERTVEKAKQRKVGNPFELDTQQGPQVDKEQFERVLGYIQLGQKEGAKLLCGGERFGERGFFIKPTVFGGVQDDMRIAKEEIFGPVQPLFKFKKIEEVVERANNTRYGLAAAVFTRDLDKAMYFTQALQAGTVWVNTYNIVTCHTPFGGFKESGNGRELGEDGLKAYTEVKTVTIKVPQKNS

SEQ ID NO: 754195 - protein, 453 aa, Homo sapiens
MLRFLAPRLLSLQGRTARYSSAAALPSPILNPDIPYNQLFINNEWQDAVSKKTFPTVNPTTGEVIGHVAEGDRADVDRAVKAAREAFRLGSPWRRMDASERGRLLNLLADLVERDRVYLASLETLDNGKPFQESYALDLDEVIKVYRYFAGWADKWHGKTIPMDGQHFCFTRHEPVGVCGQIIPWNFPLVMQGWKLAPALATGNTVVMKVAEQTPLSALYLASLIKEAGFPPGVVNIITGYGPTAGAAIAQHMDVDKVAFTGSTEVGHLIQKAAGDSNLKRVTLELGGKSPSIVLADADMEHAVEQCHEALFFNMGQCCCAGSRTFVEESIYNEFLERTVEKAKQRKVGNPFELDTQQGPQVDKEQFERVLGYIQLGQKEGAKLLCGGERFGERGFFIKPTVFGGVQDDMRIAKEEIFGPVQPLFKFKKIEEDGLKAYTEVKTVTIKVPQKNS

SEQ ID NO: 754196 - protein, 379 aa, Homo sapiens
MLRFLAPRLLSLQGRTARYSSAAALPSPILNPDIPYNQLFINNEWQDAVSKKTFPTVNPTTGEVIGHVAEGDRADVDRAVKAAREAFRLGSPWRRMDASERGRLLNLLADLVERDRVYLASLETLDNGKPFQESYALDLDEVIKVYRYFAGWADKWHGKTIPMDGQHFCFTRHEPVGVCGQIIPWNFPLVMQGWKLAPALATGNTVVMKVAEQTPLSALYLASLIKEAGFPPGVVNIITGYGPTAGAAIAQHMDVDKVAFTGSTEVGHLIQKAAGDSNLKRVTLELGGKSPSIVLADADMEHAVEQCHEALFFNMGQCCCAGSRTFVEESIYNEFLERTVEKAKQRKVGNPFELDTQQGPQVDKEQFERVLGYIQLGQK

SEQ ID NO: 754197 - protein, 517 aa, Homo sapiens; identical to SEQ ID NO: 754194

SEQ ID NO: 754198 - protein, 517 aa, Homo sapiens; identical to SEQ ID NO: 754194

SEQ ID NO: 754199 - protein, 525 aa, Homo sapiens
MLRFLAPRLLSLQGRTARYSSAAALPSPILNPDIPYNQLFINNEWQDAVSKKTFPTVNPTTGEVIGHVAEGDRADVDRAVKAAREAFRLGSPWRRMDASERGRLLNLLADLVERDRVYLASLETLDNGKPFQESYALDLDEVIKVYRYFAGWADKWHGKTIPMDGQHFCFTRHEPVGVCGQIIPWNFPLVMQGWKLAPALATGNTVVMKVAEQTPLSALYLASLIKEAGFPPGVVNIITGYGPTAGAAIAQHMDVDKVAFTGSTEVGHLIQKAAGDSNLKRVTLELGGKSPSIVLADADMEHAVEQCHEALFFNMGQCCCAGSRTFVEESIYNEFLERTVEKAKQRKVGNPFELDTQQGPQVDKEQFERVLGYIQLGQKEGAKLLCGGERFGERGFFIKPTVFGGVQDDMRIAKEEIFGPVQPLFKFKKIEEVVERANNTSNSTTTLTNACQAVLKPRTPFLCSKLTLRRNPTNKAIQSRLFYLNQRWGPGSEFYLSNPQPQPPWWPMSCFHEILGVSGGQIKNQ

SEQ ID NO: 754200 - protein, 155 aa, Homo sapiens
IAVPDVHLYPHYRSDRSEGAKLLCGGERFGERGFFIKPTVFGGVQDDMRIAKEEIFGPVQPLFKFKKIEEVVERANNTRYGLAAAVFTRDLDKAMYFTQALQAGTVWVNTYNIVTCHTPFGGFKESGNGRELGEDGLKAYTEVKTVTIKVPQKNS

SEQ ID NO: 754201 - protein, 493 aa, Homo sapiens
MLPRWELALYLLASLGFHFYSFYEVYKVSREHEEELDQEFELETDTLFGGLKKDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGDEVGKTYWNRIFIQGWPWVTLSVLGFLYCYSHVGIAWAQTYATD

SEQ ID NO: 754202 - protein, 428 aa, Homo sapiens
MLPRWELALYLLASLGFHFYSFYEVYKVSREHEEELDQEFELETDTLFGGLKKDATDFEWSFWMEWGKQWLVWLLLGHMVVSQMATLLARKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGDEVGKTYWNRIFIQGWPWVTLSVLGFLYCYSHVGIAWAQTYATD

SEQ ID NO: 754203 - protein, 428 aa, Homo sapiens; identical to SEQ ID NO: 754202

SEQ ID NO: 754204 - protein, 493 aa, Homo sapiens; identical to SEQ ID NO: 754201

SEQ ID NO: 754205 - protein, 341 aa, Homo sapiens
GRASAAAVAAAATLTPPTMDSFDLALLQEWDLESLCVYEPDRNALRRKERERRNQETQQDDGTFNSSYSLFSEPYKTNKGDELSNRIQNTLGNYDEMKDFLTDRTNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIRVRLFFKQSYQSVGHRL

SEQ ID NO: 754206 - protein, 326 aa, Homo sapiens
GRASAAAVAAAATLTPPTMDSFDLALLQEWDLESLCVYEPDRNALRRKERERRNQETQQDDGTFNSSYSLFSEPYKTNKGDELSNRIQNTLGNYDEMKDFLTDRTNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIRS

SEQ ID NO: 754207 - protein, 1228 aa, Homo sapiens
GRASAAAVAAAATLTPPTMDSFDLALLQEWDLESLCVYEPDRNALRRKERERRNQETQQDDGTFNSSYSLFSEPYKTNKGDELSNRIQNTLGNYDEMKDFLTDRTNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGNSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 754208 - protein, 854 aa, Homo sapiens
GRASAAAVAAAATLTPPTMDSFDLALLQEWDLESLCVYEPDRNALRRKERERRNQETQQDDGTFNSSYSLFSEPYKTNKGDELSNRIQNTLGNYDEMKDFLTDRTNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYRILAKPS

SEQ ID NO: 754209 - protein, 1244 aa, Homo sapiens
GRASAAAVAAAATLTPPTMDSFDLALLQEWDLESLCVYEPDRNALRRKERERRNQETQQDDGTFNSSYSLFSEPYKTNKGDELSNRIQNTLGNYDEMKDFLTDRTNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPISPNPFPGSSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 754210 - protein, 416 aa, Homo sapiens
GRASAAAVAAAATLTPPTMDSFDLALLQEWDLESLCVYEPDRNALRRKERERRNQETQQDDGTFNSSYSLFSEPYKTNKGDELSNRIQNTLGNYDEMKDFLTDRTNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSLSW

SEQ ID NO: 754211 - protein, 891 aa, Homo sapiens
GRASAAAVAAAATLTPPTMDSFDLALLQEWDLESLCVYEPDRNALRRKERERRNQETQQDDGTFNSSYSLFSEPYKTNKGDELSNRIQNTLGNYDEMKDFLTDRTNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVASTRGSLD

SEQ ID NO: 754212 - protein, 164 aa, Homo sapiens
MFCLSPVFCFQAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAA

SEQ ID NO: 754213 - protein, 234 aa, Homo sapiens
SSSTSSNHSGHTPEPPLPPVGGDLASRLSSDEGEMDGADESEKLDCQFSTHHPRPLAFCSFGSRLMGRGYYVFDRRWGSFSIRTKLHGRKTPEFTDVEAQKPEPQGIRSLPPVQDLPTNLLSLSNIGAAWVSTLESVAPRYPLNLAAQTPGPGGPEPGGMAADGGVEDIRKKRNGQDSFFFNKHLTLHQGAANTVFSFSQGRSLLRQIAPCLARSHINTPVQHPFAALATRVCF

SEQ ID NO: 754214 - protein, 1208 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 754215 - protein, 1208 aa, Homo sapiens; identical to SEQ ID NO: 754214

SEQ ID NO: 754216 - protein, 1208 aa, Homo sapiens; identical to SEQ ID NO: 754214

SEQ ID NO: 754217 - protein, 1197 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 754218 - protein, 1216 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRYFLVFFYQTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 754219 - protein, 1124 aa, Homo sapiens
MQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 754220 - protein, 1080 aa, Homo sapiens
AWSRPRYAGLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 754221 - protein, 1069 aa, Homo sapiens
MDGEDLPSVTDIRRPRLYLLKWLKSDKALMMLFNDGTFQVNFYHDHTKIIICSQNEEYLLTYINEDRISTTFRLTTLLMSGCSSELKNRMEYALNMLLQRCNMKDFSNGPYGTPLFHCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 754222 - protein, 494 aa, Homo sapiens [sequence omitted]

SEQ ID NO: 754223 - protein, 760 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQVSMIREGACLLLLLSGFSCDSLNSITL

SEQ ID NO: 754224 - protein, 426 aa, Homo sapiens [sequence omitted]

SEQ ID NO: 754225 - protein, 314 aa, Homo sapiens
MSDRNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 754226 - protein, 588 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGY

SEQ ID NO: 754227 - protein, 386 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKELLYSQ

SEQ ID NO: 754228 - protein, 1208 aa, Homo sapiens; identical to SEQ ID NO: 754214

SEQ ID NO: 754229 - protein, 279 aa, Homo sapiens
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPTLERPGRKRKWTETQDSSQKKSLEPKTKAVPKVKLLCGADLLESFAVPNLWKSEDITQIVANYGLICVTRAGNDAQKFIYESDVLWKHRSNIHVVNEWIANDISSTKIRRALRRGQSIRYLVPDLVQEYIEKHNLYSSESEDRNAGVILAPLQRNTAEAKT

SEQ ID NO: 754230 - protein, 279 aa, Homo sapiens; identical to SEQ ID NO: 754229

SEQ ID NO: 754231 - protein, 124 aa, Homo sapiens
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLSCAKGQAAVWGRFIGVLCCSQFVEE

SEQ ID NO: 754232 - protein, 160 aa, Homo sapiens
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPTLERPGRKRKWTETQDSSQKKSLEPKTKDGVSLYHPGWSAVA

SEQ ID NO: 754233 - protein, 148 aa, Homo sapiens
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPTLERPGRKRKWTETQDSSQKKSLEPKTKGL

SEQ ID NO: 754234 - protein, 153 aa, Homo sapiens
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPLHSSLGKKAKLHLKEKKKKDRVWWLTPVIPALWEA

SEQ ID NO: 754235 - protein, 107 aa, Homo sapiens
LHPKACWGCFKILKTDFGILIPQSRLLIHIHAQKHPRTHERLFGLQQVGDTDKWTRGWIIHDPIKDSKEVTLDCGQGSSTTCLETLRAFPKGILESPLLPFRGLGIL

SEQ ID NO: 754236 - protein, 66 aa, Homo sapiens
PSLRGRLCSSASHSDWTFFSTASGRGFLPGAQWSRTDAASKLFHWVPVCSSHALEPLKLLGERRSS

SEQ ID NO: 754237 - protein, 137 aa, Homo sapiens
FGQKVTLIRHQRTHTGEKPYLCPKCGRAFGFKSLLTRHQRTHSEEELYVDRVCGQGLGQKSHLISDQRTHSGEKPCICDECGRGFGFKSALIRHQRTHSGEKPYVCRECGRGFSQKSHLHRHRRTKSGHQLLPQEVF

SEQ ID NO: 754238 - protein, 295 aa, Homo sapiens
RKCSELLYVFQTQLALKLLQCLKVTDAPHFYGLPSLERTLRGMANLTAFPGWSSHSPLTKPLDICVKYLSGLLEVITSFYVERGGNAMSFMGKGVTKSTILCLLHLSHEMMAQAGSLEWMSLWFLPLGSHSEEHIPTQQGLAWLIPLWVDRDPEVRFTSLGLGSALTTLETGCVALANSCQNISGGLWGTVVNILLDQSECSMVRREAAFILQNLLVIPMPTEIIKDYTWQGPCVHDEDSGLSLIGKPALQALLYHCHFYEHLNQMVKHCYLGRCMFDLNFSAFDRNSESNDLNG

SEQ ID NO: 754239 - protein, 83 aa, Homo sapiens
DIANRWSFEGMDRWIKKIEEHAPGVPKILVGNRLHLAFKRQVPREQAQAYAERLGVTFFEVSPLCNFNIIESFTELARIVLLR

SEQ ID NO: 754240 - protein, 411 aa, Homo sapiens
NDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASL

SEQ ID NO: 754241 - protein, 220 aa, Homo sapiens
MDLLFGRRKTPEELLRQNQRALNRAMRELDRERQKLETQEKKIIADIKKMAKQGQMDAVRIMAKDLVRTRRYVRKFVLMRANIQAVSLKIQTLKSNNSMAQAMKGVTKAMGTMNRQLKLPQIQKIMMEFERQAEIMDMKEEMMNDAIDDAMGDEEDEEESDAVVSQVLDELGLSLTDELSNSLMGLAKCGAGEKARRARLCSVDWGGYGGGACPTGAVHR

SEQ ID NO: 754242 - protein, 222 aa, Homo sapiens
MDLLFGRRKTPEELLRQNQRALNRAMRELDRERQKLETQEKKIIADIKKMAKQGQMDAVRIMAKDLVRTRRYVRKFVLMRANIQAVSLKIQTLKSNNSMAQAMKGVTKAMGTMNRQLKLPQIQKIMMEFERQAEIMDMKEEMMNDAIDDAMGDEEDEEESDAVVSQVLDELGLSLTDELSNLPSTGGSLSVAAGGKKAEAAASALADADADLEERLKNLRRD

SEQ ID NO: 754243 - protein, 222 aa, Homo sapiens; identical to SEQ ID NO: 754242

SEQ ID NO: 754244 - protein, 222 aa, Homo sapiens; identical to SEQ ID NO: 754242

SEQ ID NO: 754245 - protein, 222 aa, Homo sapiens; identical to SEQ ID NO: 754242

SEQ ID NO: 754246 - protein, 222 aa, Homo sapiens; identical to SEQ ID NO: 754242

SEQ ID NO: 754247 - protein, 222 aa, Homo sapiens; identical to SEQ ID NO: 754242

SEQ ID NO: 754248 - protein, 222 aa, Homo sapiens; identical to SEQ ID NO: 754242

SEQ ID NO: 754249 - protein, 222 aa, Homo sapiens; identical to SEQ ID NO: 754242

SEQ ID NO: 754250 - protein, 222 aa, Homo sapiens; identical to SEQ ID NO: 754242

SEQ ID NO: 754251 - protein, 208 aa, Homo sapiens
LGTLTRPDSKKTKTKFFGLPARQTQEKKIIADIKKMAKQGQMDAVRIMAKDLVRTRRYVRKFVLMRANIQAVSLKIQTLKSNNSMAQAMKGVTKAMGTMNRQLKLPQIQKIMMEFERQAEIMDMKEEMMNDAIDDAMGDEEDEEESDAVVSQVLDELGLSLTDELSNLPSTGGSLSVAAGGKKAEAAASALADADADLEERLKNLRRD

SEQ ID NO: 754252 - protein, 101 aa, Homo sapiens
GVDSRGFRMSRAEIMDMKEEMMNDAIDDAMGDEEDEEESDAVVSQVLDELGLSLTDELSNLPSTGGSLSVAAGGKKAEAAASALADADADLEERLKNLRRD

SEQ ID NO: 754253 - protein, 803 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754254 - protein, 124 aa, Homo sapiens
TLEDPQRGTITSATSVHVVAVIEPIIQHADWFFPEEVEFNVSEAFVPLTTPSSNHSFHTGNDSDSGTLERKRPASMAVMEGDLVKKERYDLTVHFQTSSKYVVRPVVSGIAQWTWDLRVVAIHP

SEQ ID NO: 754255 - protein, 113 aa, Homo sapiens
RSVGTVWVSLKQCVNYLFNKMRSLCKSPTLCYLDVHSYVLGGRLRSFRLAAESFCIMYGLCLPSPLRTMPMDGDCWLCHLIKLDVTHAASLDCRNVDRNVLFFFFFLNNVIAT

SEQ ID NO: 754256 - protein, 108 aa, Homo sapiens [sequence omitted]

SEQ ID NO: 754257 - protein, 803 aa, Homo sapiens; identical to SEQ ID NO: 754253

SEQ ID NO: 754258 - protein, 881 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754259 - protein, 854 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754260 - protein, 693 aa, Homo sapiens
NKTYLSVPPKPGKGEQIIGPKIFIVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754261 - protein, 608 aa, Homo sapiens
MLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754262 - protein, 410 aa, Homo sapiens
DAVYSDCIVLGPNLSWARNEGTLAEMAAATSVHVVAVIEPIIQHADWFFPEEVEFNVSEAFVPLTTPSSNHSFHTGNDSDSGTLERKRPASMAVMEGDLVKKESPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754263 - protein, 840 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDV

SEQ ID NO: 754264 - protein, 374 aa, Homo sapiens
DSRGSPRYADWPTSEEVEFNVSEAFVPLTTPSSNHSFHTGNDSDSGTLERKRPASMAVMEGDLVKKESPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754265 - protein, 371 aa, Homo sapiens
PRGVIADWFFPEKVEFNVSEAFVPLTTPSSNHSFHTGNDSDSGTLERKRPASMAVMEGDLVKKESPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754266 - protein, 326 aa, Homo sapiens
MFRFSSWDCLTSNLTFTPLSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754267 - protein, 156 aa, Homo sapiens
MHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 754268 - protein, 853 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDALPSALTGGEGFQD

SEQ ID NO: 754269 - protein, 106 aa, Homo sapiens
MSKKQCVNYLFNKMRSLCKSPTLCYLDVHSYVLGGRLRSFRLAAESFCIMYGLCLPSPLRTMPMDGDCWLCHLIKLDVTHAASLDCRNVDRNVLFFFFFLNNVIAT

SEQ ID NO: 754270 - protein, 106 aa, Homo sapiens; identical to SEQ ID NO: 754269

SEQ ID NO: 754271 - protein, 803 aa, Homo sapiens; identical to SEQ ID NO: 754253

SEQ ID NO: 754272 - protein, 853 aa, Homo sapiens; identical to SEQ ID NO: 754268

SEQ ID NO: 754273 - protein, 840 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTGK

SEQ ID NO: 754274 - protein, 587 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKLLPVRLIPRTLPSPATFSSSRHE

SEQ ID NO: 754275 - protein, 128 aa, Homo sapiens
GALGVPAPPRITGGGQHLQQLGMSKKQCVNYLFNKMRSLCKSPTLCYLDVHSYVLGGRLRSFRLAAESFCIMYGLCLPSPLRTMPMDGDCWLCHLIKLDVTHAASLDCRNVDRNVLFFFFFLNNVIAT

SEQ ID NO: 754276 - protein, 226 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTISGRKNQPLGLP

SEQ ID NO: 754277 - protein, 575 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGR

SEQ ID NO: 754278 - protein, 226 aa, Homo sapiens; identical to SEQ ID NO: 754276

SEQ ID NO: 754279 - protein, 135 aa, Homo sapiens [sequence omitted]

SEQ ID NO: 754280 - protein, 183 aa, Homo sapiens
MFIFIKHGDNQQFLVNTNCAVVVLLYYIRSKVKLPKTNTIDLCEQTGKMKMLFLMKPNHAEYASKYLTARSTYYVCKVERGPPGTRLENAYRAFVPLLKNPEPWLLVALRIQCDALERRRIQMLKMKEAKKVVIIEPPASVPSKQSGRSDKKKSTRKSPTFRNRPDFRKNKGRQLNKTTKQKK

SEQ ID NO: 754281 - protein, 106 aa, Homo sapiens
PCARMTRFVKRSIFLSLVLRGAGAFSLFLVALRIQCDALERRRIQMLKMKEAKKVVIIEPPASVPSKQSGRSDKKKSTRKSPTFRNRPDFRKNKGRQLNKTTKQKK

SEQ ID NO: 754282 - protein, 110 aa, Homo sapiens
RVLLGVSEGTGCADAMELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 754283 - protein, 187 aa, Homo sapiens
MPDYSVHILSDVQFVKITRQQYQNALTACHMDSSPQSPDMEAFTDGDSTKAPTTRGTPQTPKDDPAITLLNNRNSLPCSRSDGLRSPSEVVYLRMEELAFTQEEMTDFEEHSTQQLTLSPAAVPTRAASDSECCNINLDTETSPCSSDFEENVGKKLLRTLSGQKRKRSPEGERTSEDNSNLTPLIT

SEQ ID NO: 754284 - protein, 655 aa, Homo sapiens
LAGWLYTSLPPGFGGTGEDYSEEGIHFPWLPALVCTGAVFLGAEICPYSVCSRHGLAIASHSVCLTRLLMAAAFPVCYPLGRLLDWALRQEISTFYTREKLLETLRAADPYSDLVKEELNIIQGALELRTKVVEEVLTPLGDCFMLRSDAVLDFATVSEILRSGYTRIPVYEGDQRHNIVDILFVKDLAFVDPDDCTPLLTVTRFYNRPLHCVFNDTRLDTVLEEFKKGKSHLAIVQRVNNEGEGDPFYEVMGIVTLEDIIEEIIKSEILDETDLYTDNRKKQRVPQRERKRHDFSLFKLSDTEMRVKISPQLLLATHRFMATEVEPFKSLYLSEKILLRLLKHPNVIQELKFDEKNKKAPEHYLYQRNRPVDYFVLLLQGKVEVEVGKEGLRFENGAFTYYGVPAIMTTACSDNDVRKVGSLAGSSVFLNRSPSRCSGLNRSESPNRERSDFGGSNTQLYSSSNNLYMPDYSVHILSDVQFVKITRQQYQNALTACHMDSSPQSPDMEAFTDGDSTKAPTTRGTPQTPKDDPAITLLNNRNSLPCSRSDGLRSPSEVVYLRMEELAFTQEEMTDFEEHSTQQLTLSPAAVPTRAASDSECCNINLDTETSPCSSDFEENVGKKLLRTLSGQKRKRSPEGERTSEDNSNLTPLIT

SEQ ID NO: 754285 - protein, 760 aa, Homo sapiens
MESASEGQEAHREVAGGAAVGLSPPAPAPFPLEPGDAATAAARVSGEEGAVAAAAAGAAADQVQLHSELLGRHHHAAAAAAQTPLAFSPDHVACVCEALQQGGNLDRLARFLWSLPQSDLLRGNESLLKARALVAFHQGIYPELYSILESHSFESANHPLLQQLWYKARYTEAERARGRPLGAVDKYRLRRKFPLPRTIWDGEETVYCFKEKSRNALKELYKQNRYPSPAEKRHLAKITGLSLTQVSNWFKNRRQRDRNPSETQSKSESDGNPSTEDESSKGHEDLSPHPLSSSSDGITNLSLSSHMEPVYMQQIGNAKISLSSSGVLLNGSLVPASTSPVFLNGNSFIQGPSGVILNGLNVGNTQAVALNPPKMSSNIVSNGISMTDILGSTSQDVKEFKVLQSSANSATTTSYSPSVPVSFPGLIPSTEVKREGIQTVASQDGGSVVTFTTPVQINQYGIVQIPNSGANSQFLNGSIGFSPLQLPPVSVAASQGNISVSSSTSDGSTFTSESTTVQQGKVFLSSLAPSAVVYTVPNTGQTIGSVKQEGLERSLVFSQLMPVNQNAQVNANLSSENISGSGLPPLASSLVNVSPTHNFSLSPSTLLNPTELNRDIADSQPMSAPVASKSTVTSVSNTNYATLQNCSLITGQDLLSVPMTQAALGEIVPTAEDQVGHPSPAVHQDFVQEHRLVLQSVANMKENFLSNSESKATSSLMMLDSKSKYVLDGMVDTVCEDLETDKKELAKLQTVQLDEDMQDL

SEQ ID NO: 754286 - protein, 517 aa, Homo sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 754287 - protein, 413 aa, Homo sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDGRTAPSSSGGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 754288 - protein, 480 aa, Homo sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDGRTAPSSSENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 754289 - protein, 106 aa, Homo sapiens
LGLLLLLGGKPLCTLLLASGGAACRACFLPCEQQVRASWSQGRLWGFPVKGPVSPSLASSEALESPGETAHCPSTQRSRASSKWTGLSYFLSNTKMQYAHYKRPKQ

SEQ ID NO: 754290 - protein, 55 aa, Homo sapiens
RRTSQEEAEKLWKLLFLMKSQGWLPQEGSVRRILCADPCCQICNVMALEIKQLLA

SEQ ID NO: 754291 - protein, 1035 aa, Homo sapiens
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 754292 - protein, 132 aa, Homo sapiens
AAAAAVAAKAAAAAAVAVAAAAPHSAAKLEERRKPDPRRMEDEAVLDRGASFLKHVCDEEEVEGHHTIYIGVHVPKSYRRRRRHKRKTGHKEKKEKERISENYSDKSDIENADESSSSILKPLSEYSLSVGA

SEQ ID NO: 754293 - protein, 1118 aa, Homo sapiens
AAAAAVAAKAAAAAAVAVAAAAPHSAAKLEERRKPDPRRMEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 754294 - protein, 1118 aa, Homo sapiens; identical to SEQ ID NO: 754293

SEQ ID NO: 754295 - protein, 218 aa, Homo sapiens
MTVAATYHGRAMREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 754296 - protein, 1118 aa, Homo sapiens; identical to SEQ ID NO: 754293

SEQ ID NO: 754297 - protein, 66 aa, Homo sapiens
GGGRGGSEGGGGGGSGSGRCSPTLRRQTGGATEARPQEGLEEEFGWSASPSLLSPLRATGRLYEDC

SEQ ID NO: 754298 - protein, 1093 aa, Homo sapiens
EKSEHSFFLFYYYRMEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 754299 - protein, 1034 aa, Homo sapiens
AAAAAVAAKAAAAAAVAVAAAAPHSAAKLEERRKPDPRRMEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 754300 - protein, 929 aa, Homo sapiens
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARFQKMRGMQVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRPSDPMGSHQRHCWWEQEGAVPLEQPGSLRIWEMALP

SEQ ID NO: 754301 - protein, 89 aa, Homo sapiens
TDNPDNPNHTTANKYVEAGGYRGDVCWPRGREKTNVLTVDLGPVADCSQQCASVVWPGAGVKVSWAKEKYELLRRGLDILPLTPHPHCR

SEQ ID NO: 754302 - protein, 829 aa, Homo sapiens
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARFQKMRGMQVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGILYNCHTEVLEIFRCNWVTGQATQDAY

SEQ ID NO: 754303 - protein, 903 aa, Homo sapiens
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARFQKMRGMQVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRTALINFLVQD

SEQ ID NO: 754304 - protein, 903 aa, Homo sapiens; identical to SEQ ID NO: 754303

SEQ ID NO: 754305 - protein, 903 aa, Homo sapiens; identical to SEQ ID NO: 754303

SEQ ID NO: 754306 - protein, 94 aa, Homo sapiens
IEKEGNHSRSCCEGCCCRQETLASWDSKEHSESPQSLWQRRTHNFLHPCRVAKKAPMASFAGSLETGSHCFSPHTHLLIISGIKQHWLLGLGLM

SEQ ID NO: 754307 - protein, 107 aa, Homo sapiens
REDSYHVRSRSSYDDRSSDRRVYDRRYCGSYRRNDYSRDRGDAYYDTDYRHSYEYQRENSSYRSQRSSRRKHRRRRRRSRTFSRSSSVSASPGPSSPHSSAGPLGLW

SEQ ID NO: 754308 - protein, 104 aa, Homo sapiens
RGLIGSQFCRLYRKHGTGISPASGEASGSFYPWQKTNRKQASHRRKQAQEHLWGRGHTFKHPDPMRTYSVSPGQNQAMRDLPHDPNTPHQAPPPILGITIQHEI

SEQ ID NO: 754309 - protein, 89 aa, Homo sapiens
AQETYNSQENTIREKARSPHQHFAFKTVGLMEGQWTEPSQTSRACWIVNISCTQVSAKVRGQEVLQGRAQVKQRLHIVGDGHSTTKLKT

SEQ ID NO: 754310 - protein, 149 aa, Homo sapiens
MLEEIRGVGTPKKLWEQHTAVEEYEQEFIAKWRSLDLDVLLVPVLGSAFYIGSSSLASESQSYVTLYNLLDFPAGVVPVTIVTLQDEEELAFYKGCYGDSSDKNFSEAVRGSVGVLVTVQCIALPWEEELCLRFMKEVDTLVKNQRGPK

SEQ ID NO: 754311 - protein, 78 aa, Homo sapiens
WALLAERGSILGMGTDTGDSICIPASFCGVYGLWTTGSRLSYTGIASAIKGKKIGDHGGWPHGPGRGEPGAVPASPAE

SEQ ID NO: 754312 - protein, 140 aa, Homo sapiens
MLEEIRGVGTPKKLWEQHTAVEEYEQEFIAKWRSLDLDVLLVPVLGSAFYIGSSSLASESQSYVTLYNLLDFPAGVVPVTIVTLQDEEELAFYKGCYGDSSDKNFSEPPYKEVQAILLEATCKRTEASQLTASTNCRACE

SEQ ID NO: 754313 - protein, 168 aa, Homo sapiens
CSFPRVIHLQDECSSLFLPVPWSLPVSPLLAQHLPPASLFPYAFTKPCLPPCSPEPLLSFPLVPPGWDSAETLLLAGRPVPVPFPAALSDCVCAVSGAAWPILPASGGWWPQVLLPLSLCSIHFPFPWALFIHLVTHGLQFSSQSEDPLWPHQCVLPTLVSQTPGIKN

SEQ ID NO: 754314 - protein, 1016 aa, Homo sapiens
KQHQNTTYFMADIISDMSVALKSWFHDMKQHQNTTYFLAQHLNKDSLLARKDLPFRIQSCAAQAVLTAPYSLGRPDPNPSLQPIATGQSPGPPGARRKLPQSEGQVQGERTYSLAVHPALSPQLSEQKNLSLLSPVPEDKGPGHTRAGLEMSLRAATSSLSEEQVSELRDNLPKEVRLSPKLILDPKSSVTPAIISAALQQVVHNKSLVTAGGALGNPPSRGERRLEASMGRPEVSMMSSSASKNLKFKISPSAPETSWNSQHQLGAEVSSSPRAPTGSRADSLHLSQQEDSLPVQNFPPKSYLLRTSRESVGKQATGEVAGKGGPVGGKPTLQKQGTISSQGEKAQLESTPKRSKLEETSLVPRATYPMALQSPSCQSRSHSPSCQPHGHSPSSQSRGQSPSCQPRGQSPLRSQAASRQVSTMPSRKLETTLNGAHSTSEGPAKPKSSRGPFRLRNLFSATFPTRQKKETDERQAQLQKVKQYELEFLEELLKPPSQGELPGTEYLQPPAPGRCSCQLRSSPVQQGPGMSREQRRSCDCKRICRGGRPQATQTPVPSLRGRERDRVLPSQRQPEAGPGVSLSSPINVQRIRSTSLESRECRSDPESGVSCLTTCASGGECLGAPNYRKLMRRYSISELDQGDRASLTSDVYPHPPLGMLPREAKEVEASLPIALGPKSRSLESPTLGDPSYVQVAPETKGPRQMAVFSLPEEVYRKPAELDEDSESSKCCSIRYCFYYRKCDMADDASDGKDELSYSIPMKILPGMKLDEQVVPVVSRTLQVLDAATCSSSSPEASRTQEIDLRVSTFEGSLAKINALRAHAYGLPDGFLAARLDTNELLTVLRQCVASPEARAPKPYVSQISEYKLELALKFKELRASCRRVANVDKSPTHMLAAITGSFQVLSSLIETFVRLVFIVRSEAQRQELLAKVEEVVRNYTFLLRAAEESTARNLNQQQQQQQQQQQQQQQQQQQQQQQQQQQVAAAAGAATEHPPGSPTSATVMSTFTHSLKTLIK

SEQ ID NO: 754315 - protein, 1016 aa, Homo sapiens; identical to SEQ ID NO: 754314

SEQ ID NO: 754316 - protein, 1016 aa, Homo sapiens; identical to SEQ ID NO: 754314

SEQ ID NO: 754317 - protein, 140 aa, Homo sapiens
VLETYLEPPPSDTMVNSCCGSVCSDQGCDQGLCQETCCRPSCCQTTCCCPSCVVSSCCRPSCSQTTCCQTTCCRPSCCRPVCCQTTCRPSCGVSSCCRPLCCQTTCRPSCGVSSCCRPLCCQTTCCRTTCCRPSCCGSSC

SEQ ID NO: 754318 - protein, 102 aa, Homo sapiens
MSFRFGQHLIKPSVVFLKTELSFALVNRKPVVPGHVLVCPLRPVERFHDLRPDEVADLFQTTQRVGTVVEKHFHGTSLTFSMQDGPEAGQTVKVSAYYVHTN

SEQ ID NO: 754319 - protein, 147 aa, Homo sapiens
MSFRFGQHLIKPSVVFLKTELSFALVNRKPVVPGHVLVCPLRPVERFHDLRPDEVADLFQTTQRVGTVVEKHFHGTSLTFSMQDGPEAGQTVKHVHVHVLPRKAGDFHRNDSIYEELQKHDKEDFPASWRSEEEMAAEAAALRVYFQ

SEQ ID NO: 754320 - protein, 147 aa, Homo sapiens; identical to SEQ ID NO: 754319

SEQ ID NO: 754321 - protein, 35 aa, Homo sapiens
KLRCTLFPTIPSGWAEVESPRFPSEGWEPITRSSN

SEQ ID NO: 754322 - protein, 45 aa, Homo sapiens
MNRCLVMISPRASAKECSPGYTFITACETESSRTSDLQNCKLIRG

SEQ ID NO: 754323 - protein, 443 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 754324 - protein, 414 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 754325 - protein, 480 aa, Homo sapiens
MPGVGFFLETSARGPLTDTLCPFFLARAWPPSGSTALMDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 754326 - protein, 502 aa, Homo sapiens
MLTACQNSVPTHPAPCLSVLLHGPLTPQSSACLLCCPPNPCVFVRSYARAWPPSGSTALMDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 754327 - protein, 279 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKVSRHPPTNSKGPHLTITKRAHLMLRWGLGKPQQGLGLG

SEQ ID NO: 754328 - protein, 105 aa, Homo sapiens
GSRPGPPLSSAGPWLPEGRPRVDAAGAGSLKQPAPSLPRGALWLEGKHRPDGAAGDSVSRGEEEGPPRGARPGPEVCAATPGRLLGSARLGSGSAWAPRRAGAEG

SEQ ID NO: 754329 - protein, 443 aa, Homo sapiens; identical to SEQ ID NO: 754323

SEQ ID NO: 754330 - protein, 443 aa, Homo sapiens; identical to SEQ ID NO: 754323

SEQ ID NO: 754331 - protein, 272 aa, Homo sapiens
MLTACQNSVPTHPAPCLSVLLHGPLTPQSSACLLCCPPNPCVFVRSYARAWPPSGSTALMDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRPERVHHCQPGLRGLLLHRLLLRALHCHPAGLHQDLHCPPQTPQASQHQTQQPSFQGPPEGSTKGQLYSPRGHETLHRYHEV

SEQ ID NO: 754332 - protein, 111 aa, Homo sapiens
MPGSPNLFPPWKLLLSTSLPLTHWNPTNGTSQAAKDHHPGKTLPENPAGFTSTATADSRALLQAYIDGHSVVIFSRSTCTRCTEVKKLFKSLCVPYFVLELDQTGKFLFNM

SEQ ID NO: 754333 - protein, 549 aa, Homo sapiens
MSCEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 754334 - protein, 497 aa, Homo sapiens
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 754335 - protein, 657 aa, Homo sapiens
SVSSHRALCDMGCAEGKAVAAAAPTELQTKGKNGDGRRRSAKDHHPGKTLPENPAGFTSTATADSRALLQAYIDGHSVVIFSRSTCTRCTEVKKLFKSLCVPYFVLELDQTEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 754336 - protein, 585 aa, Homo sapiens
NRGHAVPAGPGRKPRPRRSSRLLAGEKHLTRSALLLCHTEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 754337 - protein, 497 aa, Homo sapiens; identical to SEQ ID NO: 754334

SEQ ID NO: 754338 - protein, 497 aa, Homo sapiens; identical to SEQ ID NO: 754334

SEQ ID NO: 754339 - protein, 397 aa, Homo sapiens [sequence omitted]

SEQ ID NO: 754340 - protein, 468 aa, Homo sapiens
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKYSQHCL

SEQ ID NO: 754341 - protein, 276 aa, Homo sapiens
TIRSFSSEAWVADKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 754342 - protein, 497 aa, Homo sapiens; identical to SEQ ID NO: 754334

SEQ ID NO: 754343 - protein, 497 aa, Homo sapiens; identical to SEQ ID NO: 754334

SEQ ID NO: 754344 - protein, 497 aa, Homo sapiens; identical to SEQ ID NO: 754334

SEQ ID NO: 754345 - protein, 497 aa, Homo sapiens; identical to SEQ ID NO: 754334

SEQ ID NO: 754346 - protein, 76 aa, Homo sapiens
TSSRSRSRTDNERVVGFHVLGPNAGEVTQGFAAALKCGLTKKQLDSTIGIHPVCAEVFTTLSVTKRSGASILQAGC

SEQ ID NO: 754347 - protein, 497 aa, Homo sapiens; identical to SEQ ID NO: 754334

SEQ ID NO: 754348 - protein, 497 aa, Homo sapiens; identical to SEQ ID NO: 754334

SEQ ID NO: 754349 - protein, 180 aa, Homo sapiens [sequence omitted]

SEQ ID NO: 754350 - protein, 99 aa, Homo sapiens
MSLWLCFQCPLGVSKSGKKRINLWSWCREVPQPIVKSFEKRPRSASTPETRTKFTQDICATPSASALDSANLWVLVDCILRDTSEDLGLQCDMNLAFGR

SEQ ID NO: 754351 - protein, 217 aa, Homo sapiens
MDGAANSQLSTSQPSLRHKVNEHEQDGNELQTTPEFRAHVAKKLGALLDSFITISEAAKEPAKAKVQKVALEDDGFRLFFTSVPGGREKEESPQPRRKRQPSSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 754352 - protein, 270 aa, Homo sapiens
NPLRWFKMAAPSGTVSDSESSNSSSDAEELERCREAAMPAWGLEQRPHVAGKPRAGAANSQLSTSQPSLRHKVNEHEQDGNELQTTPEFRAHVAKKLGALLDSFITISEAAKEPAKAKVQKVALEDDGFRLFFTSVPGGREKEESPQPRRKRQPSSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 754353 - protein, 287 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYEDVLNTQCGYDVRLKLELEQQGFIHTKGCVGQFEKWLQDNLIVVAGVFMGIALLQIFGICLAQNLVSDIKAVKANWSKWNDDFENHWLTPTISEVLSTAGPQQNSLTGAPGPAPPSRHVFFGLGGLYPEPTFKNW

SEQ ID NO: 754354 - protein, 270 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANW

SEQ ID NO: 754355 - protein, 291 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANWANGMMTIDTTSLRPSRSRREL

SEQ ID NO: 754356 - protein, 202 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAVSGAGGGE

SEQ ID NO: 754357 - protein, 164 aa, Homo sapiens
RGSSPRQVVLFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANW

SEQ ID NO: 754358 - protein, 141 aa, Homo sapiens
LATGILAFVFKDWIRDQLNLFINNNVKAYRDDIDLQNLIDFAQEYVSPVSSLDTCRRRLPGRRMREQVPCDGTISLPTWASGPQERDPGVSSSEESQPLLILMGPHLPSAIGPRPWETEGMGSTLAAPRPGPTTHGRMEEM

SEQ ID NO: 754359 - protein, 329 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANWSKWNDDFENHWLTPTISEVLSTAGPQQNSLTGAPGPAPPSRHVFFGLGGLYPEPTFKNW

SEQ ID NO: 754360 - protein, 263 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLEQME

SEQ ID NO: 754361 - protein, 96 aa, Homo sapiens
GRGRGYSAEGALLLCVRNPAEDVLNTQCGYDVRLKLELEQQGFIHTKGCVGQFEKWLQDNLIVVAGVFMGIALLQIFGICLAQNLVSDIKAVKANW

SEQ ID NO: 754362 - protein, 1024 aa, Homo sapiens
MSNAKERKHAKKMRNQPTNVTLSSGFVADRGVKHHSGGEKPFQAQKQEPHPGTSRQRQTRVNPHSLPDPEVNEQSSSKGMFRKKGGWKAGPEGTSQEIPKYITASTFAQARAAEISAMLKAVTQKSSNSLVFQTLPRHMRRRAMSHNVKRLPRRLQEIAQKEAEKAVHQKKEHSKNKCHKARRCHMNRTLEFNRRQKKNIWLETHIWHAKRFHMVKKWGYCLGERPTVKSHRACYRAMTNRCLLQDLSYYCCLELKGKEEEILKALSGMCNIDTGLTFAAVHCLSGKRQGSLVLYRVNKYPREMLGPVTFIWKSQRTPGDPSESRQLWIWLHPTLKQDILEEIKAACQCVEPIKSAVCIADPLPTPSQEKSQTELPDEKIGKKRKRKDDGENAKPIKKIIGDGTRDPCLPYSWISPTTGIIISDLTMEMNRFRLIGPLSHSILTEAIKAASVHTVGEDTEETPHRWWIETCKKPDSVSLHCRQEAIFELLGGITSPAEIPAGTILGLTVGDPRINLPQKKSKALPNPEKCQDNEKVRQLLLEGVPVECTHSFIWNQDICKSVTENKISDQDLNRMRSELLVPGSQLILGPHESKIPILLIQQPGKVTGEDRLGWGSGWDVLLPKGWGMAFWIPFIYRGVRVGGLKESAVHSQYKRSPNVPGDFPDCPAGMLFAEEQAKNLLEKYKRRPPAKRPNYVKLGTLAPFCCPWEQLTQDWESRVQAYEEPSVASSPNGKESDLRRSEVPCAPMPKKTHQPSDEVGTSIEHPREAEEVMDAGCQESAGPERITDQEASENHVAATGSHLCVLRSRKLLKQLSAWCGPSSEDSRGGRRAPGRGQQGLTREACLSILGHFPRALVWVSLSLLSKGSPEPHTMICVPAKEDFLQLHEDWHYCGPQESKHSDPFRSKILKQKEKKKREKRQKPGRASSDGPAGEEPVAGQEALTLGLWSGPLPRVTLHCSRTLLGFVTQGDFSMAVGCGEALGFVSLTGLLDMLSSQPAAQRGLVLLRPPASLQYRFARIAIEV

SEQ ID NO: 754363 - protein, 945 aa, Homo sapiens
MFRKKGGWKAGPEGTSQEIPKYITASTFAQARAAEISAMLKAVTQKSSNSLVFQTLPRHMRRRAMSHNVKRLPRRLQEIAQKEAEKAVHQKKEHSKNKCHKARRCHMNRTLEFNRRQKKNIWLETHIWHAKRFHMVKKWGYCLGERPTVKSHRACYRAMTNRCLLQDLSYYCCLELKGKEEEILKALSGMCNIDTGLTFAAVHCLSGKRQGSLVLYRVNKYPREMLGPVTFIWKSQRTPGDPSESRQLWIWLHPTLKQDILEEIKAACQCVEPIKSAVCIADPLPTPSQEKSQTELPDEKIGKKRKRKDDGENAKPIKKIIGDGTRDPCLPYSWISPTTGIIISDLTMEMNRFRLIGPLSHSILTEAIKAASVHTVGEDTEETPHRWWIETCKKPDSVSLHCRQEAIFELLGGITSPAEIPAGTILGLTVGDPRINLPQKKSKALPNPEKCQDNEKVRQLLLEGVPVECTHSFIWNQDICKSVTENKISDQDLNRMRSELLVPGSQLILGPHESKIPILLIQQPGKVTGEDRLGWGSGWDVLLPKGWGMAFWIPFIYRGVRVGGLKESAVHSQYKRSPNVPGDFPDCPAGMLFAEEQAKNLLEKYKRRPPAKRPNYVKLGTLAPFCCPWEQLTQDWESRVQAYEEPSVASSPNGKESDLRRSEVPCAPMPKKTHQPSDEVGTSIEHPREAEEVMDAGCQESAGPERITDQEASENHVAATGSHLCVLRSRKLLKQLSAWCGPSSEDSRGGRRAPGRGQQGLTREACLSILGHFPRALVWVSLSLLSKGSPEPHTMICVPAKEDFLQLHEDWHYCGPQESKHSDPFRSKILKQKEKKKREKRQKPGRASSDGPAGEEPVAGQEALTLGLWSGPLPRVTLHCSRTLLGFVTQGDFSMAVGCGEALGFVSLTGLLDMLSSQPAAQRGLVLLRPPASLQYRFARIAIEV

SEQ ID NO: 754364 - protein, 1024 aa, Homo sapiens; identical to SEQ ID NO: 754362

SEQ ID NO: 754365 - protein, 827 aa, Homo sapiens
MSNAKERKHAKKMRNQPTNVTLSSGFVADRGVKHHSGGEKPFQAQKQEPHPGTSRQRQTRVNPHSLPDPEVNEQSSSKGMFRKKGGWKAGPEGTSQEIPKYITASTFAQARAAEISAMLKAVTQKSSNSLVFQTLPRHMRRRAMSHNVKRLPRRLQEIAQKEAEKAVHQKKEHSKNKCHKARRCHMNRTLEFNRRQKKNIWLETHIWHAKRFHMVKKWGYCLGERPTVKSHRACYRAMTNRCLLQDLSYYCCLELKGKEEEILKALSGMCNIDTGLTFAAVHCLSGKRQGSLVLYRVNKYPREMLGPVTFIWKSQRTPGDPSESRQLWIWLHPTLKQDILEEIKAACQCVEPIKSAVCIADPLPTPSQEKSQTELPDEKIGKKRKRKDDGENAKPIKKIIGDGTRDPCLPYSWISPTTGIIISDLTMEMNRFRLIGPLSHSILTEAIKAASVHTVGEDTEETPHRWWIETCKKPDSVSLHCRQEAIFELLGGITSPAEIPAGTILGLTVGDPRINLPQKKSKALPNPEKCQDNEKVRQLLLEGVPVECTHSFIWNQDICKSVTENKISDQDLNRMRSELLVPGSQLILGPHESKIPILLIQQPGKVTGEDRLGWGSGWDVLLPKGWGMAFWIPFIYRGVRVGGLKESAVHSQYKRSPNVPGDFPDCPAGMLFAEEQAKNLLEKYKRRPPAKRPNYVKLGTLAPFCCPWEQLTQDWESRVQAYEEPSVASSPNGKESDLRRSEVPCAPMPKKTHQPSDEVGTSIEHPREAEEVMDAGCQESAGPERITDQEASENHVAATGSHLCVLRSRKLLKQLSAWCGPSSEDCY

SEQ ID NO: 754366 - protein, 127 aa, Homo sapiens
MRSPARSPGALARWVLSRRLVILTRGFLTASGRLVVRGWCLPGCECRGNCMRRPPSRRPSPLFIVSLSDSADLFPCCLCPGPLSLVSHLLRPLRWSPLRQSFPFIAPPGGRPSWEWACIPSSATPND

SEQ ID NO: 754367 - protein, 1024 aa, Homo sapiens; identical to SEQ ID NO: 754362

SEQ ID NO: 754368 - protein, 1024 aa, Homo sapiens; identical to SEQ ID NO: 754362

SEQ ID NO: 754369 - protein, 261 aa, Homo sapiens
MPRKAPCLWRHVSPGLSQGPTIPTTVPCREDILCPSGQTDGDSPGPPPEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 754370 - protein, 162 aa, Homo sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTGRECAHPRPPSQPQLLARLCSPSPCRGTLP

SEQ ID NO: 754371 - protein, 240 aa, Homo sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 754372 - protein, 231 aa, Homo sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTASALPDPPAASALPAALAVISFLLGLGLGVACVLARTQIKKLCSWRDKNSAACVVYEDMSHSRCNTLSSPNQYQ

SEQ ID NO: 754373 - protein, 240 aa, Homo sapiens; identical to SEQ ID NO: 754371

SEQ ID NO: 754374 - protein, 268 aa, Homo sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQITNCARGGYDRPLCVSRLSRRGTAVSPPSVTCPPPLLPPPPPSPPPPPPPPPPPPPPPAPPPPP

SEQ ID NO: 754375 - protein, 267 aa, Homo sapiens
LSSERLRSPVCCSLWGPVDPERLSCTRPAGRAGCGEHGRASEAPAAAPASGAGSRPAWGPGCPRLMVTAQVLPEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQVSVSPSCHLHPKDCSLS

SEQ ID NO: 754376 - protein, 1513 aa, Homo sapiens
ERRPERSEGGKMADRFSRFNEDRDFQGNHFDQYEEGHLEIEQASLDKPIESDNIGHRLLQKHGWKLGQGLGKSLQGRTDPIPIVVKYDVMGMGRMEMELDYAEDATERRRVLEVEKEDTEELRQKYKDYVDKEKAIAKALEDLRANFYCELCDKQYQKHQEFDNHINSYDHAHKQRLKDLKQREFARNVSSRSRKDEKKQEKALRRLHELAEQRKQAECAPGSGPMFKPTTVAVDEEGGEDDKDESATNSGTGATASCGLGSEFSTDKGGPFTAVQITNTTGLAQAPGLASQGISFGIKNNLGTPLQKLGVSFSFAKKAPVKLESIASVFKDHAEEGTSEDGTKPDEKSSDQGLQKVGDSDGSSNLDGKKEDEDPQDGGSLASTLSKLKRMKREEGAGATEPEYYHYIPPAHCKVKPNFPFLLFMRASEQMDGDNTTHPKNAPESKKGSSPKPKSCIKAAASQGAEKTVSEVSEQPKETSMTEPSEPGSKAEAKKALGGDVSDQSLESHSQKVSETQMCESNSSKETSLATPAGKESQEGPKHPTGPFFPVLSKDESTALQWPSELLIFTKAEPSISYSCNPLYFDFKLSRNKDARTKGTEKPKDIGSSSKDHLQGLDPGEPNKSKEVGGEKIVRSSGGRMDAPASGSACSGLNKQEPGGSHGSETEDTGRSLPSKKERSGKSHRHKKKKKHKKSSKHKRKHKADTEEKSSKAESGEKSKKRKKRKRKKNKSSAPADSERGPKPEPPGSGSPAPPRRRRRAQDDSQRRSLPAEEGSSGKKDEGGGGSSSQDHGGRKHKGELPPSSCQRRAGTKRSSRSSHRSQPSSGDEDSDDASSHRLHQKSPSQYSEEEEEEDSGSEHSRSRSRSGRRHSSHRSSRRSYSSSSDASSDQSCYSRQRSYSDDSYSDYSDRSRRHSKRSHDSDDSDYASSKHRSKRHKYSSSDDDYSLSCSQSRSRSRSHTRERSRSRGRSRSSSCSRSRSKRRSRSTTAHSWQRSRSYSRDRSRSTRSPSQRSGSRKRSWGHESPEERHSGRRDFIRSKIYRSQSPHYFRSGRGEGPGKKDDGRGDDSKATGPPSQNSNIGTGRGSEGDCSPEDKNSVTAKLLLEKIQSRKVERKPSVSEEVQATPNKAGPKLKDPPQGYFGPKLPPSLGNKPVLPLIGKLPATRKPNKKCEESGLERGEEQEQSETEEGPPGSSDALFGHQFPSEETTGPLLDPPPEESKSGEATADHPVAPLGTPAHSDCYPGDPTISHNYLPDPSDGDTLESLDSSSQPGPVESSLLPIAPDLEHFPSYAPPSGDPSIESTDGAEDASLAPLESQPITFTPEEMEKYSKLQQAAQQHIQQQLLAKQVKAFPASAALAPATPALQPIHIQQPATASATSITTVQHAILQHHAAAAAAAIGIHPHPHPQPLAQVHHIPQPHLTPISLSHLTHSIIPGHPATFLASHPIHIIPASAIHPGPFTFHPVPHAALYPTLLAPRPAAAAATALHLHPLLHPIFSGQDLQHPPSHGT

SEQ ID NO: 754377 - protein, 1495 aa, Homo sapiens
ERRPERSEGGKMADRFSRFNEDRDFQGNHFDQYEEGHLEIEQASLDKPIESDNIGHRLLQKHGWKLGQGLGKSLQGRTDPIPIVVKYDVMGMGRMEMELDYAEDATERRRVLEVEKEDTEELRQKYKDYVDKEKAIAKALEDLRANFYCELCDKQYQKHQEFDNHINSYDHAHKQRLKDLKQREFARNVSSRSRKDEKKQEKALRRLHELAEQRKQAECAPGSGPMFKPTTVAVDEEGGEDDKDESATNSGTGATASCGLGSEFSTDKGGPFTAVQITNTTGLAQAPGLASQGISFGIKNNLGTPLQKLGVSFSFAKKAPVKLESIASVFKDHAEEGTSEDGTKPDEKSSDQGLQKVGDSDGSSNLDGKKEDEDPQDGGSLASTLSKLYIPPAHCKVKPNFPFLLFMRASEQMDGDNTTHPKNAPESKKGSSPKPKSCIKAAASQGAEKTVSEVSEQPKETSMTEPSEPGSKAEAKKALGGDVSDQSLESHSQKVSETQMCESNSSKETSLATPAGKESQEGPKHPTGPFFPVLSKDESTALQWPSELLIFTKAEPSISYSCNPLYFDFKLSRNKDARTKGTEKPKDIGSSSKDHLQGLDPGEPNKSKEVGGEKIVRSSGGRMDAPASGSACSGLNKQEPGGSHGSETEDTGRSLPSKKERSGKSHRHKKKKKHKKSSKHKRKHKADTEEKSSKAESGEKSKKRKKRKRKKNKSSAPADSERGPKPEPPGSGSPAPPRRRRRAQDDSQRRSLPAEEGSSGKKDEGGGGSSSQDHGGRKHKGELPPSSCQRRAGTKRSSRSSHRSQPSSGDEDSDDASSHRLHQKSPSQYSEEEEEEDSGSEHSRSRSRSGRRHSSHRSSRRSYSSSSDASSDQSCYSRQRSYSDDSYSDYSDRSRRHSKRSHDSDDSDYASSKHRSKRHKYSSSDDDYSLSCSQSRSRSRSHTRERSRSRGRSRSSSCSRSRSKRRSRSTTAHSWQRSRSYSRDRSRSTRSPSQRSGSRKRSWGHESPEERHSGRRDFIRSKIYRSQSPHYFRSGRGEGPGKKDDGRGDDSKATGPPSQNSNIGTGRGSEGDCSPEDKNSVTAKLLLEKIQSRKVERKPSVSEEVQATPNKAGPKLKDPPQGYFGPKLPPSLGNKPVLPLIGKLPATRKPNKKCEESGLERGEEQEQSETEEGPPGSSDALFGHQFPSEETTGPLLDPPPEESKSGEATADHPVAPLGTPAHSDCYPGDPTISHNYLPDPSDGDTLESLDSSSQPGPVESSLLPIAPDLEHFPSYAPPSGDPSIESTDGAEDASLAPLESQPITFTPEEMEKYSKLQQAAQQHIQQQLLAKQVKAFPASAALAPATPALQPIHIQQPATASATSITTVQHAILQHHAAAAAAAIGIHPHPHPQPLAQVHHIPQPHLTPISLSHLTHSIIPGHPATFLASHPIHIIPASAIHPGPFTFHPVPHAALYPTLLAPRPAAAAATALHLHPLLHPIFSGQDLQHPPSHGT

SEQ ID NO: 754378 - protein, 1496 aa, Homo sapiens
ERRPERSEGGKMADRFSRFNEDRDFQGNHFDQYEEGHLEIEQASLDKPIESDNIGHRLLQKHGWKLGQGLGKSLQGRTDPIPIVVKYDVMGMGRMEMELDYAEDATERRRVLEVEKEDTEELRQKYKDYVDKEKAIAKALEDLRANFYCELCDKQYQKHQEFDNHINSYDHAHKQRLKDLKQREFARNVSSRSRKDEKKQEKALRRLHELAEQRKQAECAPGSGPMFKPTTVAVDEEGGEDDKDESATNSGTGATASCGLGSEFSTDKGGPFTAVQITNTTGLAQAPGLASQGISFGIKNNLGTPLQKLGVSFSFAKKAPVKLESIASVFKDHAEEGTSEDGTKPDEKSSDQGLQKVGDSDGSSNLDGKKEDEDPQDGGSLASTLSKLKRMKREEGAGATEPEYYHYIPPAHCKVKPNFPFLLFMRASEQMDGDNTTHPKNAPESKKGSSPKPKSCIKAAASQGAEKTVSEVSEQPKETSMTEPSEPGSKAEAKKALGGDVSDQSLESHSQKVSETQMCESNSSKETSLATPAGKESQEGPKHPTGPFFPVLSKDESTALQWPSELLIFTKAEPSISYSCNPLYFDFKLSRNKDARTKGTEKPKDIGSSSKDHLQGLDPGEPNKSKEVGGEKIVRSSGGRMDAPASGSACSGLNKQEPGGSHGSETEDTGRSLPSKKERSGKSHRHKKKKKHKKSSKHKRKHKADTEEKSSKAESGEKSKKRKKRKRKKNKSSAPADSERGPKPEPPGSGSPAPPRRRRRAQDDSQRRSLPAEEGSSGKKDEGGGGSSSQDHGGRKHKGELPPSSCQRRAGTKRSSRSSHRSQPSSGDEDSDDASSHRLHQKSPSQYSEEEEEEDSGSEHSRSRSRSGRRHSSHRSSRRSYSSSSDASSDQSCYSRQRSYSDDSYSDYSDRSRRHSKRSHDSDDSDYASSKHRSKRHKYSSSDDDYSLSCSQSRSRSRSHTRERSRSRGRSRSSSCSRSRSKRRSRSTTAHSWQRSRSYSRDRSRSTRSPSQRSGSRKRSWGHESPEERHSGRRDFIRSKIYRSQSPHYFRSGRGEGPGKKDDGRGDDSKATGPPSQNSNIGTGRGSEGDCSPEDKNSVTAKLLLEKIQSRKVERKPSVSEEVQATPNKAGPKLKDPPQGYFGPKLPPSLGNKPVLPLIGKLPATRKPNKKCEESGLERGEEQEQSETEEGPPGSSDALFGHQFPSEETTGPLLDPPPEESKSGEATADHPVAPLGTPAHSDCYPGDPTISHNYLPDPSDGDTLESLDSSSQPGPVESSLLPIAPDLEHFPSYASLAPLESQPITFTPEEMEKYSKLQQAAQQHIQQQLLAKQVKAFPASAALAPATPALQPIHIQQPATASATSITTVQHAILQHHAAAAAAAIGIHPHPHPQPLAQVHHIPQPHLTPISLSHLTHSIIPGHPATFLASHPIHIIPASAIHPGPFTFHPVPHAALYPTLLAPRPAAAAATALHLHPLLHPIFSGQDLQHPPSHGT

SEQ ID NO: 754379 - protein, 219 aa, Homo sapiens
ERRPERSEGGKMADRFSRFNEDRDFQGNHFDQYEEGHLEIEQASLDKPIESDNIGHRLLQKHGWKLGQGLGKSLQGRTDPIPIVVKYDVMGMGRMEMELDYAEDATERRRVLEVEKEDTEELRQKYKDYVDKEKAIAKALEDLRANFYCELCDKQYQKHQEFDNHINSYDHAHKQRLKDLKQREFARNVSSRSRKDEKKQEKALRRLHELAEQRKQAEW

SEQ ID NO: 754380 - protein, 1513 aa, Homo sapiens; identical to SEQ ID NO: 754376

SEQ ID NO: 754381 - protein, 1532 aa, Homo sapiens
MEQQTSQGTRKGDSMGQQGLKMTEAKVNCLGIEWVGSGLNEVPSSLYFLLSPLEGPNLTPEASPDPLPEPPLASVEVPDKPSGSPGQPPSPAPSPVPEPDAQAEDVAPPPTMAEEEEGTTGELRSAEPAPADSRHPLTYRKTTNFALDKFLDPARPYKCTVCKESFTQKNILLVHYNSVSHLHKMKKAAIDPSAPARGEAGAPPTTTAATDKPFKCTVCRVSYNQSSTLEIHMRSVLHQTRSRGTKTDSKIEGPERSQEEPKEGETEGEVGTEKKGPDTSGFISGLPFLSPPPPPLDLHRFPAPLFTPPVLPPFPLVPESLLKLQQQQLLLPFYLHDLKVGPKLTLAGPAPVLSLPAATPPPPPQPPKAELAEREWERPPMAKEGNEAGPSSPPDPLPNEAARTAAKALLENFGFELVIQYNEGKQAVPPPPTPPPPEALGGGDKLACGACGKLFSNMLILKTHEEHVHRRFLPFEALSRYAAQFRKSYDSLYPPLAEPPKPPDGSLDSPVPHLGPPFLVPEPEAGGTRAPEERSRAGGHWPIEEEESSRGNLPPLVPAGRRFSRTKFTEFQTQALQSFFETSAYPKDGEVERLASLLGLASRVVVVWFQNARQKARKNACEGGSMPTGGGTGGASGCRRCHATFSCVFELVRHLKKCYDDQTLEEEEEEAERGEEEEEVEEEEVEEEQGLEPPAGPEGPLPEPPDGEELSQAEATKAGGKEPEEKATPSPSPAHTCDQCAISFSSQDLLTSHRRLHFLPSLQPSAPPQLLDLPLLVFGERNPLVAATSPMPGPPLKRKHEDGSLSPTGSEAGGGGEGEPPRDKRLRTTILPEQLEILYRWYMQDSNPTRKMLDCISEEVGLKKRVVQVWFQNTRARERKGQFRSTPGGVPSPAVKPPATATPASLPKFNLLLGKVDDGTGREAPKREAPAFPYPTATLASGPQPFLPPGKEATTPTPEPPLPLLPPPPPSEEEGPEEPPKASPESEACSLSAGDLSDSSASSLAEPESPGAGGTSGGPGGGTGVPDGMGQRRYRTQMSSLQLKIMKACYEAYRTPTMQECEVLGEEIGLPKRVIQVWFQNARAKEKKAKLQGTAAGSTGGSSEGLLAAQRTDCPYCDVKYDFYVSCRGHLFSRQHLAKLKEAVRAQLKSESKCYDLAPAPEAPPALKAPPATTPASMPLGAAPTLPRLAPVLLSGPALAQPPLGNLAPFNSGPAASSGLLGLATSVLPTTTVVQTAGPGRPLPQRPMPDQTNTSTAGTTDPVPGPPTEPLGDKVSSERKPVAGPTSSSNDALKNLKALKTTVPALLGGQFLPFPLPPAGGTAPPLQGAYFQQLYGMKKGLFPMNPMIPQTLIGLLPNALLQPPPQPPEPTATAPPKPPELPAPGEGEAGEVDELLTGSTGISTVDVTHRYLCRQCKMAFDGEAPATAHQRSFCFFGRGSGGSMPPPLRVPICTYHCLACEVLLSGREALASHLRSSAHRRKAAPPQGGPPISITNAATAASAAVAFAKEEARLPHTDSNPKTTTTSTLLAL

SEQ ID NO: 754382 - protein, 1538 aa, Homo sapiens
MEQQTSQGTRKGDSMGQQGLKMTEAKVNCLGIEWVGSGLNEVPSSLYFLLSPLEGPNLTPEASPDPLPEPPLASVEVPDKPSGSPGQPPSPAPSPVPEPDAQAEDVAPPPTMAEEEEGTTGELRSAEPAPADSRHPLTYRKTTNFALDKFLDPARPYKCTVCKESFTQKNILLVHYNSVSHLHKMKKAAIDPSAPARGEAGAPPTTTAATDKPFKCTVCRVSYNQSSTLEIHMRSVLHQTRSRGTKTDSKIEGPERSQEEPKEGETEGEVGTEKKGPDTSGFISGLPFLSPPPPPLDLHRFPAPLFTPPVLPPFPLVPESLLKLQQQQLLLPFYLHDLKVGPKLTLAGPAPVLSLPAATPPPPPQPPKAELAEREWERPPMAKEGNEAGPSSPPDPLPNEAARTAAKALLENFGFELVIQYNEGKQAVPPPPTPPPPEALGGGDKLACGACGKLFSNMLILKTHEEHVHRRFLPFEALSRYAAQFRKSYDSLYPPLAEPPKPPDGSLDSPVPHLGPPFLVPEPEAGGTRAPEERSRAGGHWPIEEEESSRGNLPPLVPAGRRFSRTKFTEFQTQALQSFFETSAYPKDGEVERLASLLGLASRVVVVWFQNARQKARKNACEGGSMPTGGGTGGASGCRRCHATFSCVFELVRHLKKCYDDQTLEEEEEEAERGEEEEEVEEEEVEEEQGLEPPAGPEGPLPEPPDGEELSQAEATKAGGKEPEEKATPSPSPAHTCDQCAISFSSQDLLTSHRRLHFLPSLQPSAPPQLLDLPLLVFGERNPLVAATSPMPGPPLKRKHEDGSLSPTGSEAGGGGEGEPPRDKRLRTTILPEQLEILYRWYMQDSNPTRKMLDCISEEVGLKKRVVQVWFQNTRARERKGQFRSTPGGVPSPAVKPPATATPASLPKFNLLLGKVDDGTGREAPKREAPAFPYPTATLASGPQPFLPPGKEATTPTPEPPLPLLPPPPPSEEEGPEEPPKASPESEACSLSAGDLSDSSASSLAEPESPGAGGTSGGPGGGTGVPDGMGQRRYRTQMSSLQLKIMKACYEAYRTPTMQECEVLGEEIGLPKRVIQVWFQNARAKEKKAKLQGTAAGSTGGSSEGLLAAQRTDCPYCDVKYDFYVSCRGHLFSRQHLAKLKEAVRAQLKSESKCYDLAPAPEAPPALKAPPATTPASMPLGAAPTLPRLAPVLLSGPALAQPPLGNLAPFNSGPAASSGLLGLATSVLPTTTVVQTAGPGRPLPQRPMPDQTNTSTAGTTDPVPGPPTEPLGDKVSSERKPVAGPTSSSNDALKNLKALKTTVPALLGGQFLPFPLPPAGGTAPPAVFGPQLQGAYFQQLYGMKKGLFPMNPMIPQTLIGLLPNALLQPPPQPPEPTATAPPKPPELPAPGEGEAGEVDELLTGSTGISTVDVTHRYLCRQCKMAFDGEAPATAHQRSFCFFGRGSGGSMPPPLRVPICTYHCLACEVLLSGREALASHLRSSAHRRKAAPPQGGPPISITNAATAASAAVAFAKEEARLPHTDSNPKTTTTSTLLAL

SEQ ID NO: 754383 - protein, 1532 aa, Homo sapiens; identical to SEQ ID NO: 754381

SEQ ID NO: 754384 - protein, 1532 aa, Homo sapiens; identical to SEQ ID NO: 754381

SEQ ID NO: 754385 - protein, 122 aa, Homo sapiens
PPHRECLMRAFPMPGADGSPLATPSADTVIQLFSHPRDRPIVLKWLPRTWHKLPEGRTCLSCPLIGPLAKCLAYNRCSIAIYWMEGWMDGHTDREDPLYLENPRGIIIYDYFIMPISFIKIC

SEQ ID NO: 754386 - protein, 824 aa, Homo sapiens
RRSADRLHRAPLTLRPWTDRQSNGTETSLSPQARSVPPGKMQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFTLNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 754387 - protein, 824 aa, Homo sapiens; identical to SEQ ID NO: 754386

SEQ ID NO: 754388 - protein, 824 aa, Homo sapiens; identical to SEQ ID NO: 754386

SEQ ID NO: 754389 - protein, 784 aa, Homo sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFTLNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 754390 - protein, 784 aa, Homo sapiens; identical to SEQ ID NO: 754389

SEQ ID NO: 754391 - protein, 110 aa, Homo sapiens
MSKPTHDCMTEPSHVSLHLAVVTSQGTDPQAHLAEGKALPCPTSVVTHASSTGTFHCKHTLEKWHQSTERGREGDTKLTLRHGPRFPLWAKPLTLQGIVDNTDLFVLTNN

SEQ ID NO: 754392 - protein, 824 aa, Homo sapiens; identical to SEQ ID NO: 754386

SEQ ID NO: 754393 - protein, 824 aa, Homo sapiens; identical to SEQ ID NO: 754386

SEQ ID NO: 754394 - protein, 824 aa, Homo sapiens; identical to SEQ ID NO: 754386

SEQ ID NO: 754395 - protein, 796 aa, Homo sapiens
MCLLFPSVPPGKMQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFTLNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 754396 - protein, 493 aa, Homo sapiens
MTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFTLNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 754397 - protein, 305 aa, Homo sapiens
RRSADRLHRAPLTLRPWTDRQSNGTETSLSPQARSVPPGKMQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQSEPLL

SEQ ID NO: 754398 - protein, 120 aa, Homo sapiens
CEQMQARWGCSRGRGQECPRRGRYRGRDSAGSEREARLRGMALWSGQGHDHRKPGKWKQTGACWSSWSFVWGTGGRRQALHPDLPLPRMRVFSACWMMCCPCSWRKRPPSHPLLPVALTC

SEQ ID NO: 754399 - protein, 120 aa, Homo sapiens; identical to SEQ ID NO: 754398

SEQ ID NO: 754400 - protein, 102 aa, Homo sapiens
TGRAWDQPGAFVYTSMGTINPAGHGPTSLCDRPDRSAIPTASRKATGRGPRWHGFLRPGICSQSRSRQPPLPLCDSVCTYACMCVPVWCGSQGHPWGWDNKR

SEQ ID NO: 754401 - protein, 63 aa, Homo sapiens
RRGAVFAKPPRVWELRASAADFHPAALQKVSSLPSAIPNKETPSQSHLRVEGKLEGWGASLRG

SEQ ID NO: 754402 - protein, 469 aa, Homo sapiens
MGPLTFTDVAIEFSLEEWQCLDTAQQNLYRNVMLENYRNLVFLGIAVSKPDLITCLEKEKEPCKMKRHEMVDEPPVVCSHFAEDFWPEQDIKDSFQKVTLRRYDKRGHENLQLRKGYKTVGDCKLYKGGYNGLNQCLTLTQSKMYHCDIYVKVFYAFSNADRYKTRHTGKKPFQCKKCGKSFCMLSQLTQHKKIHIRENTYRCKEFGNAFNQSSALTNHKRIYVGEKHYRCEECGKAFNHYSTLTNHKRIHSGEKPYKCDECGKTFSISSTFTKHKIIHTEEKPYKCKECGKAFNRSSTLTSHKRIHTGEKPYKCEECGKAFNWSSTLTKHKVIHTGEKPYKCEECGKAFNQSSRLTRHKKIHTGEEPYKFEKCGRVFTCSSTLTQDKKIHTGEKPYNCEECGKVFTYSSTLTRHKRIHTEEKPYKCNECGKAFNRSSHLTSHRRIHTGEKPYKCEECGKAFKQSSNLN

SEQ ID NO: 754403 - protein, 143 aa, Homo sapiens
MGPLTFTDVAIEFSLEEWQCLDTAQQNLYRNVMLENYRNLVFLGIAVSKPDLITCLEKEKEPCKMKRHEMVDEPPVVCSHFAEDFWPEQDIKDSFQKVTLRRYDKRGHENLQLRKGYKTVGDCKLYKGGYNGLNQCLTHSSHL

SEQ ID NO: 754404 - protein, 232 aa, Homo sapiens
TNHKRIYVGEKHYRCEECGKAFNHYSTLTNHKRIHTGEKPYKCKECGKAFSRYSTLTTHKRIHSGEKPYKCDECGKTFSISSTFTKHKIIHTEEKPYKCKECGKAFNRSSTLTSHKRIHTGEKPYKCEECGKAFNWSSTLTKHKVIHTGEKPYKCEECGKAFNQSSRLTRHKKIHTGEEPYKFEKCGRVFTCSSTLTQDKKIHTGEKPYNCEECGKVFTYSSTLTRHKRIHT

SEQ ID NO: 754405 - protein, 210 aa, Homo sapiens
FTLLETQLDPSPSDTMVNSCCGSVCSHQGCGQDLCQETCCRPSCCETTCCRTTYCRPSCCVSSCCRPQCCQSVCCQPTCCRPRCCISSCCRPSCCVSSCCKPQCCQSMCCQPTCCRPRCCISSCCRPSCCVSSCCRPQCCQSVCCQPTCCHPSCSISSCCRPSCCESSCCRPCCCLRPVCGGVSCHTTCYRPTCVISSCPRPLCCASSCC

SEQ ID NO: 754406 - protein, 103 aa, Homo sapiens
EEEGAVPAEHQVAMAAARALGDVTVLGSLLLQHLLHFSTPGLVLRSLGALTGPQLLSLAQSPAGSHVLDAILTSPSVTRKLRRRVLQNLKRDNMWLWPVVAMA

SEQ ID NO: 754407 - protein, 421 aa, Homo sapiens
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKAPRPSSILMEARVDLIDLDLCNSTQWYNGRVQPTNVCAGYPVGKIDTCQGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 754408 - protein, 212 aa, Homo sapiens
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKGFLECPAGTSPFKTGVAVALELCP

SEQ ID NO: 754409 - protein, 457 aa, Homo sapiens
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKAPRPSSILMEARVDLIDLDLCNSTQWYNGRVQPTNVCAGYPVGKIDTCQQETMSLWKLSSQSLPTPLGRGRVAQADSDLCVLLDKGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 754410 - protein, 421 aa, Homo sapiens; identical to SEQ ID NO: 754407

SEQ ID NO: 754411 - protein, 83 aa, Homo sapiens
NDVQLQVAVLTQGREVALLGGDSDTEELTQRQPEARGELQASVGLGVQSITETGPLLEHFPTHWRAVVPPRTPLRHVSLPGVS

SEQ ID NO: 754412 - protein, 115 aa, Homo sapiens
MSESSKVIHLTSFTDISECLKPQLDRRYAYTEEPRVKTVSDVGALGGSDMENLLQSLYVENRAGFFFTKFCEHSGNKLWKNSVYFWFDLQAYHQLFYQETLQPFKVCKQAQVRSK

SEQ ID NO: 754413 - protein, 1331 aa, Homo sapiens
AEWISDQAGFQRPFLPTSTLNSNLKCKPCTENEQRARNVLRLPVYNVGLGAVSHDFIYSKEIRFEGDNVIFCLVSEPPTITEEEFEDSLATDDFLVDYFNEFLSLPTFSEAIRFNADYGVFEVANDAPQFLEKQLKKILQNQQPRNPIYDVVRKGKNEVKPVQMNAPDEDETINVNYNIMCLSREEGIKWIKKERLPAFLESDCYFEYRLAKLVSQVRWSKSGMNFTVGSNFSPWIVKKPPSLPPPATEEDNLVIMKKFYVSLGEASYTQTKDWFALAKQSQQTVSTFSLPCCVPYNKLKSPAISSVSENFIFDDGVHPRTKKDPSKTNKLISEFEEEEGEEEEVSVSLQDTPSQALLRVYLEKKQDVDESLTMHFSTCEEFLSSYIYFILRGAIQQIVGKPVGETPDYINFNNITKVSFDDCFESIHGKNFLSELVQTTKERSEEIEQTSLSSKNESAGPESRADWCISHRTYDIGNRKEFERFKKFIKGTLGERYWWLWMDIERLKVLKDPGRHQRHLEKMKKCYLVSNGDYYLSAEILSKFKLLDGSQWNEEHLRNIQSEVLKPLLLYWAPRFCVTHSASTKYASAELKFWHLRQAKPRKDIDPFPQMATLLPLRPKSCIPQIPEIQKEEFSLSQPPKSPNKSPEVKTATQKPWKRELLYPGSSKDDVIEKGSKYMSESSKVIHLTSFTDISECLKPQLDRRYAYTEEPRVKTVSDVGALGGSDMENLLQSLYVENRAGFFFTKFCEHSGNKLWKNSVYFWFDLQAYHQLFYQETLQPFKVCKQAQYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEIQKHVQNRLENVWLPLFLASEQFAARQKIKVQMKDIAEELLLQKAEKKIGVWKPVESKWISSSCKIIAFRKALLNPVTSRQFQRFVALKGDLLENGLLFWQEVQKYKDLCHSHCDESVIQKKITTIINCFINSSIPPALQIDIPVEQAQKIIEHRKELGPYVFREAQMTIFGVLFKFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGLQPLTNFKASSSTMSLKKNMSAHSSQK

SEQ ID NO: 754414 - protein, 1264 aa, Homo sapiens
MPEKRLTAEPPTITEEEFEDSLATDDFLVDYFNEFLSLPTFSEAIRFNADYGVFEVANDAPQFLEKQLKKILQNQQPRNPIYDVVRKGKNEVKPVQMNAPDEDETINVNYNIMCLSREEGIKWIKKERLPAFLESDCYFEYRLAKLVSQVRWSKSGMNFTVGSNFSPWIVKKPPSLPPPATEEDNLVIMKKFYVSLGEASYTQTKDWFALAKQSQQTVSTFSLPCCVPYNKLKSPAISSVSENFIFDDGVHPRTKKDPSKTNKLISEFEEEEGEEEEVSVSLQDTPSQALLRVYLEKKQDVDESLTMHFSTCEEFLSSYIYFILRGAIQQIVGKPVGETPDYINFNNITKVSFDDCFESIHGKNFLSELVQTTKERSEEIEQTSLSSKNESAGPESRADWCISHRTYDIGNRKEFERFKKFIKGTLGERYWWLWMDIERLKVLKDPGRHQRHLEKMKKCYLVSNGDYYLSAEILSKFKLLDGSQWNEEHLRNIQSEVLKPLLLYWAPRFCVTHSASTKYASAELKFWHLRQAKPRKDIDPFPQMATLLPLRPKSCIPQIPEIQKEEFSLSQPPKSPNKSPEVKTATQKPWKRELLYPGSSKDDVIEKGSKYMSESSKVIHLTSFTDISECLKPQLDRRYAYTEEPRVKTVSDVGALGGSDMENLLQSLYVENRAGFFFTKFCEHSGNKLWKNSVYFWFDLQAYHQLFYQETLQPFKVCKQAQYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEIQKHVQNRLENVWLPLFLASEQFAARQKIKVQMKDIAEELLLQKAEKKIGVWKPVESKWISSSCKIIAFRKALLNPVTSRQFQRFVALKGDLLENGLLFWQEVQKYKDLCHSHCDESVIQKKITTIINCFINSSIPPALQIDIPVEQAQKIIEHRKELGPYVFREAQMTIFGVLFKFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGLQPLTNFKASSSTMSLKKNMSAHSSQK

SEQ ID NO: 754415 - protein, 579 aa, Homo sapiens
MDCGARGVEGAMETWQEDSLATDDFLVDYFNEFLSLPYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEIQKHVQNRLENVWLPLFLASEQFAARQKIKVQMKDIAEELLLQKAEKKIGVWKPVESKWISSSCKIIAFRKALLNPVTSRQFQRFVALKGDLLENGLLFWQEVQKYKDLCHSHCDESVIQKKITTIINCFINSSIPPALQIDIPVEQAQKIIEHRKELGPYVFREAQMTIFGVLFKFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGLQPLTNFKASSSTMSLKKNMSAHSSQK

SEQ ID NO: 754416 - protein, 1252 aa, Homo sapiens
MPEKRLTAEPPTITEEEFEDSLATDDFLVDYFNEFLSLPTFSEAIRFNADYGVFEVANDAPQFLEKQLKKILQNQQPRNPIYDVVRKGKNEVKPVQMNAPDEDETINVNYNIMCLSREEGIKWIKKERLPAFLESDCYFEYRLAKLVSQVRWSKSGMNFTVGSNFSPWIVKKPPSLPPPATEEDNLASYTQTKDWFALAKQSQQTVSTFSLPCCVPYNKLKSPAISSVSENFIFDDGVHPRTKKDPSKTNKLISEFEEEEGEEEEVSVSLQDTPSQALLRVYLEKKQDVDESLTMHFSTCEEFLSSYIYFILRGAIQQIVGKPVGETPDYINFNNITKVSFDDCFESIHGKNFLSELVQTTKERSEEIEQTSLSSKNESAGPESRADWCISHRTYDIGNRKEFERFKKFIKGTLGERYWWLWMDIERLKVLKDPGRHQRHLEKMKKCYLVSNGDYYLSAEILSKFKLLDGSQWNEEHLRNIQSEVLKPLLLYWAPRFCVTHSASTKYASAELKFWHLRQAKPRKDIDPFPQMATLLPLRPKSCIPQIPEIQKEEFSLSQPPKSPNKSPEVKTATQKPWKRELLYPGSSKDDVIEKGSKYMSESSKVIHLTSFTDISECLKPQLDRRYAYTEEPRVKTVSDVGALGGSDMENLLQSLYVENRAGFFFTKFCEHSGNKLWKNSVYFWFDLQAYHQLFYQETLQPFKVCKQAQYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEIQKHVQNRLENVWLPLFLASEQFAARQKIKVQMKDIAEELLLQKAEKKIGVWKPVESKWISSSCKIIAFRKALLNPVTSRQFQRFVALKGDLLENGLLFWQEVQKYKDLCHSHCDESVIQKKITTIINCFINSSIPPALQIDIPVEQAQKIIEHRKELGPYVFREAQMTIFGVLFKFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGLQPLTNFKASSSTMSLKKNMSAHSSQK

SEQ ID NO: 754417 - protein, 104 aa, Homo sapiens
MNAPDEDETINVNYNIMCLIVTQGITRGSHPHTHFQHFCETVIVTLTYSVTPHGSHTVRHWSQVRPAISTRTDQHFFSPDSVHKTRIPVLSKASLAQLATHRKL

SEQ ID NO: 754418 - protein, 1283 aa, Homo sapiens
AEWISDQAGFQRPFLPTSTLNSNLKCKPCTENEQRARNVLRLPVYNVGLGAVSHDFIYSKEIRFEGDNVIFCLVSEPPTITEEEFEDSLATDDFLVDYFNEFLSLPLGLWTHYGNKIDTPKLLLPFQEQALSNTTGYSRSSCLTFSEAIRFNADYGVFEVANDAPQFLEKQLKKILQNQQPRNPIYDVVRKGKNEVKPVQMNAPDEDETINVNYNIMASYTQTKDWFALAKQSQQTVSTFSLPCCVPYNKLKSPAISSVSENFIFDDGVHPRTKKDPSKTNKLISEFEEEEGEEEEVSVSLQDTPSQALLRVYLEKKQDVDESLTMHFSTCEEFLSSYIYFILRGAIQQIVGKPVGETPDYINFNNITKVSFDDCFESIHGKNFLSELVQTTKERSEEIEQTSLSSKNESAGPESRADWCISHRTYDIGNRKEFERFKKFIKGTLGERYWWLWMDIERLKVLKDPGRHQRHLEKMKKCYLVSNGDYYLSAEILSKFKLLDGSQWNEEHLRNIQSEVLKPLLLYWAPRFCVTHSASTKYASAELKFWHLRQAKPRKDIDPFPQMATLLPLRPKSCIPQIPEIQKEEFSLSQPPKSPNKSPEVKTATQKPWKRELLYPGSSKDDVIEKGSKYMSESSKVIHLTSFTDISECLKPQLDRRYAYTEEPRVKTVSDVGALGGSDMENLLQSLYVENRAGFFFTKFCEHSGNKLWKNSVYFWFDLQAYHQLFYQETLQPFKVCKQAQYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEIQKHVQNRLENVWLPLFLASEQFAARQKIKVQMKDIAEELLLQKAEKKIGVWKPVESKWISSSCKIIAFRKALLNPVTSRQFQRFVALKGDLLENGLLFWQEVQKYKDLCHSHCDESVIQKKITTIINCFINSSIPPALQIDIPVEQAQKIIEHRKELGPYVFREAQMTIFGVLFKFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGLQPLTNFKASSSTMSLKKNMSAHSSQK

SEQ ID NO: 754419 - protein, 71 aa, Homo sapiens
CWGLFGHVKLCLVHSHIRKPLHGGPSQPEPHTWHRRLSQMGTRGASNAPHVLACVRFSWRNFTRCVLVEWG

SEQ ID NO: 754420 - protein, 484 aa, Homo sapiens
RLVLARVVMMTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGRVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 754421 - protein, 645 aa, Homo sapiens
AEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMSLSVGTLILGLDSEACSLKESLPLFKIRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGRVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 754422 - protein, 246 aa, Homo sapiens
AASGPPPRGRPSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCTQEQ

SEQ ID NO: 754423 - protein, 403 aa, Homo sapiens
LRIKGFNGCFVLSSPKRCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGRVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 754424 - protein, 489 aa, Homo sapiens
AASGPPPRGRPSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGRVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 754425 - protein, 489 aa, Homo sapiens; identical to SEQ ID NO: 754424

SEQ ID NO: 754426 - protein, 259 aa, Homo sapiens
MVEFYAPWCGHCKNLEPEWAAAASEVKEQTKGRVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 754427 - protein, 2990 aa, Homo sapiens
MAAQSSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIASTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTPEWSPRLIQCLGNYFCTLEASKTVQTFVSSGHQTLKKKHHEMARTFVHLNSQQQCDHWLDTVVYAEAEMRRLAPEMILPFLTKGQKCNLALNGCMNGLETFLFFFKTSRIQVANEMRRNSFNSESEFHVISVATLVHSQKEIFFFNNDFVVKGFVDDFFSFEFWEKYLFNNFYMAICKPEVMKDSTVPHFLPMNSGLIIPSIVVIYKIEGNPRSCRPQSPHCLERCTLTPALTSHYCAESQPTSEREEEPQHMGCHLEVCTGGLGAAISYPCHFPPLLQRKGLSNRAVTVDSILNFLPWGRREPTFIPDQMAKVLLKFCLRELEFEVLICGLQLCGNSCCPANSEFLSVNKKHEICFLEEAIFFCYKYFIFIAKLDFQSLDCLGEVNSLRGCRDLGWLIRLLKNSSPHAFTPECSQLDLIWLRRNCGPPEVIAIVYALNQVHFEMTYNEVTQSEIPCAHKHRFFFFIETLKVIIGNITLSAVFLKANSFLSLLEVEFAHFTTIEECHLYNFFSAFVPFCPWTCFLPSMFHIFLLVEEGEPYLFIMKTSKIPMMNAGTLLVVCKYTKGCVEGWERCLSLTVCVVCVRLFLQFFSRLFFGCHLSQRSGPSCLGESQRMTAVVISEHKTLMCDFLMTGFIYSCNKAKALVLFKLLVLKTCVEMNSNCLVEFGVCVALCVHLLYVKDKAPESGFISILKMLFNIFLFFLTPLAIPSPFVLSFPRTSHLSIVKGCVLYGRFYADCARACACSVGKPQCSLDRRHFQVDFSASSKTDCFFSGLTLCGFFFFSELDIKILFVPGKSNKCAEINLYYFGHWIFLILIALYLKESNYMVTFLIEYVKGVADESLTFIGSFCCYGCIERSEGFLKGFALFHCMLTIPKGKICTEVDHLKGLDYKIKPYSMESSYNNNSTHFRVRQMQSILRSENRVYILPLALQGVCVCVCCVSLVGNGRTLFYFLKCLMFLSFLWIIEFKSPAEIMKKHFTKIYQIILGSDCENIGHLVAVVRSGRAQQAFIRNRITIGGEFGCLILGFDYNTEWEKYLIFCNKKTFILSVLTKICSYFPYTDWTALISLVLYPLISGLRMFRKLKPPTPFWLKIALFGILHINVTSIRSLLFYYDSSSVIFRSKKKAIVSSTINKTYLWYTKGYKYIHLNREKEVDGIVPLSEPSFEIPLCLFRHGFRDATWLLHLLLLCFMKFELYLCILNRLRLEAGLSGFFVFCFVLFCFVFLYLNLLASYHRFFIFPNTTKKLLKLCHFICLHSLPLISSIYILQEYFVLSLETQEYRFFSLKSESYALQPWRDARINYGSTFFPLLFLSQLSLLFWVPLRINGCKVFSCAFILCHSIGRRCNGRIASCWGFSFKHCKWYCHHVNLKYAIQLCWFLGDLECSSLHEIVSTDHVLQFLIMVSGQIPTTAFLQVAINFLLSGGNDIIFCSTERQRSAGTVLGREVPILLYLRGQEGNPTAPCEPDILVYRPGEDKGIRPLIVRLAKLHWSDQAVADLRKQLALLKSRFFKQCLTQAAFTFVQAIDMYVLKLLHIPLRYQVYTVHVGVVCVYVCMYARMCPKSCFNFFFLNVIMFWIIPEQGCLFFIYYHYILYYIIYFLLSYNFGGKSNLGIIKIVLKRSKFSSLINENHWPMFNKFFFNYCGINVPAIINTMILYIGREAVMLSMGRCATQIKGNSMYFTYFSNGTATWGFVNENLAALYSRLKEYVICERIIVFFRRKICKRSFQRQCATDLLFSVMRINCCLNKNVIDSSLNSFLFIRGSSCKKTKKLIKISRN

SEQ ID NO: 754428 - protein, 192 aa, Homo sapiens
MGTWILFACLVGAAFAMPLPPHPGHPGYINFSYEVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEVD

SEQ ID NO: 754429 - protein, 597 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLNRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVPHFQKLFGVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 754430 - protein, 547 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLNRACHQQNKIKDLQKEQKTLQVKCQHYKKKRTEQEETIASLQMEVCRLKKEEEDRIVTQNRVFAYLCKRVPHTVLDRQFATLIDYVARFMQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVPHFQKLFGVPSLNGVYPRMNEVYTRLGEMNNAVRNLQELLELDSSSSLCVLVSTVGKLCRLINEDVNEQVMQVLGPEDLQRYLF

SEQ ID NO: 754431 - protein, 617 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLNRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKSLEEKENTLIVSPKKGFAMVDLYKSLKTLSAELVPWLNLKKQDENEGIKVEDLLFIVDTMLEEVENKEKDSNMPHFQTLQAIVPHFQKLFGVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 754432 - protein, 610 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLNRACHQQNKIKDLQKEQKTLQVKCQHYKKKRTEQEETIASLQMEVCRLKKEEEDRIVTQNRVFAYLCKRVPHTVLDRQFATLIDYVARFMQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKSLEEKENTLIVSPKKGFAMVDLYKSLKTLSAELVPWLNLKKQDENEGIKVEDLLFIVDTMLEEVENKEKDSNMPHFQTLQAIVPHFQKLFGVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 754433 - protein, 597 aa, Homo sapiens
MTEQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLNRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKSLEEKENTLIVSPKKGFAMVDLYKSLKTLSAELVPWLNLKKQDENEGIKVEDLLFIVDTMLEEVENKEKDSNMPHFQTLQAIVPHFQKLFGVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 754434 - protein, 597 aa, Homo sapiens; identical to SEQ ID NO: 754429

SEQ ID NO: 754435 - protein, 617 aa, Homo sapiens; identical to SEQ ID NO: 754431

SEQ ID NO: 754436 - protein, 114 aa, Homo sapiens
MGHLCIPTTHRHFYYPPSGCQCINDSRIRRNQRSLLSPSHNQCRRVPRNKSRNPSIWVKTANLPSVTVHEVPLSPTYFGLTPSSFPFPVCRVAFLGLRQYAKRPKVRPWLKHCG

SEQ ID NO: 754437 - protein, 119 aa, Homo sapiens
HVYHLDSTTNILLYLLYHIPVHAAILCPSLAHLFLGVFQSQLQTSAYFPLTYFRIHVNQRAMLFVVLFFLFEAKFAFDEAHRSLAYYLMSLGTCTHLCNSQPYQDRKMPGMVAHACNSS

SEQ ID NO: 754438 - protein, 85 aa, Homo sapiens
AAAPPNAPGGPPGPQPAPSAAAPPPPAHALGGMDAELIDEEALTSLELELGLHRVRELPELFLGQSEFDCFSDLGSAPPAGSVSC

SEQ ID NO: 754439 - protein, 67 aa, Homo sapiens
QSRPKRLTIGNSRPRRLGPARALREGGGGGCVRRARHRTGTLASLQALPPAGGQFGFTSLTPASAVK

SEQ ID NO: 754440 - protein, 122 aa, Homo sapiens
EHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQTATIS

SEQ ID NO: 754441 - protein, 85 aa, Homo sapiens; identical to SEQ ID NO: 754438

SEQ ID NO: 754442 - protein, 136 aa, Homo sapiens
SFISFSFSCIYLIFISFSRPKSVLVYHCTSGNLNPCNRGKMGFQVLATFEIPIPFERALTRPYADFTTSNFRTQYWNAISQQAPAIIYDFYLWLTGRKPRQGQDGSKSNQPPLQPATSCWQDLFLHPVKSQGGTRA

SEQ ID NO: 754443 - protein, 168 aa, Homo sapiens
SFISFSFSCIYLIFISFSRPKSVLVYHCTSGNLNPCNRGKMGFQVLATFEIPIPFERALTRPYADFTTSNFRTQYWNAISQQAPAIIYDFYLWLTGRKPSFSQNLRSCYGKHTRSHVLKREHAHHRPRTFNLSIPRISKPGVSSLTCGKFVHLIMNQSAFHCVKIKSR

SEQ ID NO: 754444 - protein, 100 aa, Homo sapiens
SFISFSFSCIYLIFISFSRPKSVLVYHCTSGNLNPCNRGKMGFQVLATFEIPIPFERALTRPYADFTTSNFRTQYWNAISQQAPAIIYDFYLWLTGRKPR

SEQ ID NO: 754445 - protein, 75 aa, Homo sapiens
KHTRELEEQVLGHLLLPDLLCAAFVLEESGKRLKKTRKYDIITTPAERVEMAPLNEEDDEDEDSTVFDIKYRPEW

SEQ ID NO: 754446 - protein, 188 aa, Homo sapiens
RRIPRCRPPCWCGSWSSAARALPDPVPTHRTMRAVPLPAPLLPLLLLALLAAPAARASRAESVSAPRPEPERESRPPPGPGPGNTTRFGSGAAGGSGSSNSSGDALVTRISILLRDLPTLKAAVIVAFAFTTLLIACLLLRVFRSGKRLKKTRKYDIITTPAERVEMAPLNEEDDEDEDSTVFDIKYR

SEQ ID NO: 754447 - protein, 188 aa, Homo sapiens; identical to SEQ ID NO: 754446

SEQ ID NO: 754448 - protein, 188 aa, Homo sapiens; identical to SEQ ID NO: 754446

SEQ ID NO: 754449 - protein, 188 aa, Homo sapiens; identical to SEQ ID NO: 754446

SEQ ID NO: 754450 - protein, 188 aa, Homo sapiens; identical to SEQ ID NO: 754446

SEQ ID NO: 754451 - protein, 313 aa, Homo sapiens
MCDRGIQMLITTVGAFAAFSLMTIAVGTDYWLYSRGVCRTKSTSDNETSRKNEEVMTHSGLWRTCCLEGAFRGVCKKIDHFPEDADYEQDTAEYLLRAVRASSVFPILSVTLLFFGGLCVAASEFHRSRHNVILSAGIFFVSAGLSNIIGIIVYISANAGDPGQRDSKKSYSYGWSFYFGAFSFIIAEIVGVVAVHIYIEKHQQLRAKSHSEFLKKSTFARLPPYRYRFRRRSSSRSTEPRSRDLSPISKGFHTIPSTDISMFTLSRDPSKITMGTLLNSDRDHAFLQFHNSTPKEFKESLHNNPANRRTTPV

SEQ ID NO: 754452 - protein, 302 aa, Homo sapiens
FQVPSLFTSHREPTVGTDYWLYSRGVCRTKSTSDNETSRKNEEVMTHSGLWRTCCLEGAFRGVCKKIDHFPEDADYEQDTAEYLLRAVRASSVFPILSVTLLFFGGLCVAASEFHRSRHNVILSAGIFFVSAGLSNIIGIIVYISANAGDPGQRDSKKSYSYGWSFYFGAFSFIIAEIVGVVAVHIYIEKHQQLRAKSHSEFLKKSTFARLPPYRYRFRRRSSSRSTEPRSRDLSPISKGFHTIPSTDISMFTLSRDPSKITMGTLLNSDRDHAFLQFHNSTPKEFKESLHNNPANRRTTPV

SEQ ID NO: 754453 - protein, 157 aa, Homo sapiens
MLLITSVKLAVSATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKGGFIKERIWHLG

SEQ ID NO: 754454 - protein, 215 aa, Homo sapiens
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQVNSLFRCVHLILTMKPHVAGPRIYCSASSKSHH

SEQ ID NO: 754455 - protein, 660 aa, Homo sapiens
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 754456 - protein, 251 aa, Homo sapiens
MADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 754457 - protein, 169 aa, Homo sapiens
RVREALPKDVSEDPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 754458 - protein, 650 aa, Homo sapiens
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKGGFIKERIWHLG

SEQ ID NO: 754459 - protein, 164 aa, Homo sapiens
PAAASPSAASLCAASPPAATLAAASPAAAAPAAVCPAAASPSAASLCAASPPAATLAAASPAAAAPLAVNPAAAAPAAACVQSVAESPATPLAIAQPVSSPPVPAPCAAPPLAAEPTALAHLSLRRWSTNVDHSSVLNIRTHGVGLMSFSRVDLMYPMSPSPSR

SEQ ID NO: 754460 - protein, 931 aa, Homo sapiens
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKFVAHPNCQQQLLSIWYENLSGLRQQTMAVKFLVVLAVAIGLPFLALIYWFAPCSKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 754461 - protein, 931 aa, Homo sapiens; identical to SEQ ID NO: 754460

SEQ ID NO: 754462 - protein, 876 aa, Homo sapiens
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 754463 - protein, 815 aa, Homo sapiens
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 754464 - protein, 394 aa, Homo sapiens
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKVRSGVKPVYIILVLVGAK

SEQ ID NO: 754465 - protein, 75 aa, Homo sapiens
ERKSFPSSVLTARLFVHGCVRLCPLPSPFNMLPCQGSCPYDVPDSFCTLACFLAPRCSQHPAALGQPLLAPYGCV

SEQ ID NO: 754466 - protein, 4327 aa, Homo sapiens
LGLGHTFWTLLASPKMEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLLCILFI

SEQ ID NO: 754467 - protein, 4327 aa, Homo sapiens; identical to SEQ ID NO: 754466

SEQ ID NO: 754468 - protein, 65 aa, Homo sapiens
MYNIKQSTDTKEAAAIEARRNREKERQNRFFNVRNRVMGVDVQALNNQVGDRKRREAAERSKEAA

SEQ ID NO: 754469 - protein, 68 aa, Homo sapiens
TRRKPPPRPPGTAPAAGLRSVHLLRIPYKEPLLVHQNYRGPSAQLPQTLAVGPPMAVGTSPVKPAKLD

SEQ ID NO: 754470 - protein, 1204 aa, Homo sapiens
MVGVLAMAAAAAPPPVKDCEIEPCKKRKKDDDTSTCKTITKYLSPLGKTRDRVFAPPKPSNILDYFRKTSPTNEKTQLGKECKIKSPESVPVDSNKDCTTPLEMFSNVEFKKKRKRVNLSHQLNNIKTENEAPIEISSDDSKEDYSLNNDFVESSTSVLRYKKQVEVLAENIQDTKSQPNTMTSLQNSKKVNPKQGTTKNDFKKLRKRKCRDVVDLSESLPLAEELNLLKKDGKDTKQMENTTSHANSRDNVTEAAQLNDSIITVSYEEFLKSHKENKVEEIPDSTMSICVPSETVDEIVKSGYISESENSEISQQVRFKTVTVLAQVHPIPPKKTGKIPRIFLKQKQFEMENSLSDPENEQTVQKRKSNVVIQEEELELAVLEAGSSEAVKPKCTLEERQQFMKAFRQPASDALKNGVKKSSDKQKDLNEKCLYEVGRDDNSKKIMENSGIQMVSKNGNLQLHTDKGSFLKEKDKKLKKKNKKTLDTGAIPGKNREGNTQKKETTFFLKEKQYQNRMSLRQRKTEFFKSSTLFNNESLVYEDIANDDLLKVSSLCNNNKLSRKTSIPVKDIKLTQSKAESEASLLNVSTPKSTRRSGRISSTPTTETIRGIDSDDVQDNSQLKASTQKAANLSEKHSLYTAELITVPFDSESPIRMKFTRISTPKKSKKKSNKRSEKSEATDGGFTSQIRKASNTSKNISKAKQLIEKAKALHISRSKVTEEIAIPLRRSSRHQTLPERKKLSETEDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKDSGTEDMLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPSK

SEQ ID NO: 754471 - protein, 548 aa, Homo sapiens
MKFTRISTPKKSKKKSNKRSEKSEATDGGFTSQIRKASNTSKNISKAKQLIEKAKALHISRSKVTEEIAIPLRRSSRHQTLPERKKLSETEDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKDSGTEDMLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPSK

SEQ ID NO: 754472 - protein, 88 aa, Homo sapiens
VKDIKLTQSKAESEASLLNVSTPKSTRRSGRISSTPTTETIRGIDSDDVQDNSQLKASTQKAANLSEKHSLYTAELITVPFDSESPIR

SEQ ID NO: 754473 - protein, 465 aa, Homo sapiens
MVGVLAMAAAAAPPPVKDCEIEPCKKRKKDDDTSTCKTITKYLSPLGKTRDRVFAPPKPSNILDYFRKTSPTNEKTQLGKECKIKSPESVPVDSNKDCTTPLEMFSNVEFKKKRKRVNLSHQLNNIKTENEAPIEISSDDSKEDYSLNNDFVESSTSVLRYKKQVEVLAENIQDTKSQPNTMTSLQNSKKVNPKQGTTKNDFKKLRKRKCRDVVDLSESLPLAEELNLLKKDGKDTKQMENTTSHANSRDNVTEAAQLNDSIITVSYEEFLKSHKENKVEEIPDSTMSICVPSETVDEIVKSGYISESENSEISQQVRFKTVTVLAQVHPIPPKKTGKIPRIFLKQKQFEMENSLSDPENEQTVQKRKSNVVIQEEELELAVLEAGSSEAVKPKCTLEERQQFMKAFRQPASDALKNGVKKSSDKQKDLNEKCLYEVGRDDNSKKIMENSGIQMVSKNGNLQFTH

SEQ ID NO: 754474 - protein, 228 aa, Homo sapiens
MVGVLAMAAAAAPPPVKDCEIEPCKKRKKDDDTSTCKTITKYLSPLGKTRDRVFAPPKPSNILDYFRKTSPTNEKTQLGKECKIKSPESVPVDSNKDCTTPLEMFSNVEFKKKRKRVNLSHQLNNIKTENEAPIEISSDDSKEDYSLNNDFVESSTSVLRYKKQVEVLAENIQDTKSQPNTMTSQSAGITGMSHRAQPHSVYIAFPKYAIDLFIYIALYRMSIPNPKI

SEQ ID NO: 754475 - protein, 228 aa, Homo sapiens
RGSLICVIAKAPAFYRLCSSSDTLLSEGEENQKPKKSDTKVDSSPRRKHSSSSNSQGSIHKSKEDVTVSPSQEINAPPDENKRTPSPGPVESKFLERAGDASAPRFNTEQIQYRDSREINAVVTPERRPTSSPRPTSSELLRSHSTDRRVYSRFEPFCKIESSIQPTSNMPNTSINRPEIKSATMGNSYGRSSPLLNYNTGVYRSYQPNENKFRGFMQKFGNFIHKNK

SEQ ID NO: 754476 - protein, 241 aa, Homo sapiens
GSQKLRSLLSLTPDKKENLSKNKAPAFYRLCSSSDTLLSEGEENQKPKKSDTKVDSSPRRKHSSSSNSQGSIHKSKEDVTVSPSQEINAPPDENKRTPSPGPVESKFLERAGDASAPRFNTEQIQYRDSREINAVVTPERRPTSSPRPTSSELLRSHSTDRRVYSRFEPFCKIESSIQPTSNMPNTSINRPEIKSATMGNSYGRSSPLLNYNTGVYRSYQPNENKFRGFMQKFGNFIHKNK

SEQ ID NO: 754477 - protein, 524 aa, Homo sapiens
ARAESRAGRGPRGVGQPERRPPIPGGRPRAPARAPASGRLAHATERPSGRRRSCPGPCCCCCRLRLLPQLGARLLHGVRRSCSLLSRQTTFLLASSPRMFRTKRSALVRRLWRSRAPGGEDEEEGAGGGGGGGELRGEGATDSRAHGAGGGGPGRAGCCLGKAVRGAKGHHHPHPPAAGAGAAGGAEADLKALTHSVLKKLKERQLELLLQAVESRGGTRTACLLLPGRLDCRLGPGAPAGAQPAQPPSSYSLPLLLCKVFRWPDLRHSSEVKRLCCCESYGKINPELVCCNPHHLSRLCELESPPPPYSRYPMDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 754478 - protein, 524 aa, Homo sapiens; identical to SEQ ID NO: 754477

SEQ ID NO: 754479 - protein, 219 aa, Homo sapiens [sequence omitted]

SEQ ID NO: 754480 - protein, 111 aa, Homo sapiens
MAGPLFSLAFLIYRVSPPSLLQIPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 754481 - protein, 211 aa, Homo sapiens
MDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 754482 - protein, 134 aa, Homo sapiens
RATEPGPQAAPCQLSSSHSRSNRLLSPMARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 754483 - protein, 72 aa, Homo sapiens
RATEPGPQAAPCQLSSSHSRSNRLLSPMARATLSAAPSNPRLLRVALLLLLLVAASRRAAASLFFPRSAPGH

SEQ ID NO: 754484 - protein, 167 aa, Homo sapiens
ESDRARATGSSLPALLLAQPLEPPAEPHGPRHALRRPQQSPAPAGGAAAPAPGGRQPARSRWVPAPWGPRAGRGWGGRPAPTAPLNQRVSSSLGAPLATELRCQCLQTLQGIHLKNIQSVKVKSPGPHCAQTEVIATLKNGQKACLNPASPMVKKIIEKMLKNGKSN

SEQ ID NO: 754485 - protein, 135 aa, Homo sapiens
ESDRARATGSSLPALLLAQPLEPPAEPHGPRHALRRPQQSPAPAGGAAAPAPGGRQPARSRWVPAPWGPRAGRGWGGRPAPTAPLNQRVSSSLGAPLATELRCQCLQTLQGIHLKNIQSVKVKSPGPHCAQTEVM

SEQ ID NO: 754486 - protein, 135 aa, Homo sapiens; identical to SEQ ID NO: 754485

SEQ ID NO: 754487 - protein, 135 aa, Homo sapiens; identical to SEQ ID NO: 754485

SEQ ID NO: 754488 - protein, 135 aa, Homo sapiens; identical to SEQ ID NO: 754485

SEQ ID NO: 754489 - protein, 155 aa, Homo sapiens
RATEPGPQAAPCQLSSSHSRSNRLLSPMARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNLKEALPLQEQKRKERHSCRGHLDCA

SEQ ID NO: 754490 - protein, 134 aa, Homo sapiens; identical to SEQ ID NO: 754482

SEQ ID NO: 754491 - protein, 134 aa, Homo sapiens
MDVFMKGLSMAKEGVVAAAEKTKQGVTEAAEKTKEGVLYVGSKTREGVVQGVASVAEKTKEQASHLGGAVFSGAGNIAAATGLVKREEFPTDLKPEEVAQEAAEEPLIEPLMEPEGESYEDPPQEEYQEYEPEA

SEQ ID NO: 754492 - protein, 134 aa, Homo sapiens; identical to SEQ ID NO: 754491

SEQ ID NO: 754493 - protein, 134 aa, Homo sapiens; identical to SEQ ID NO: 754491

SEQ ID NO: 754494 - protein, 167 aa, Homo sapiens
EYLEDPSRLADRLSLDSFSPITRSSFRSEATPSEPVLVSVHLSVLPARVQPRGMDRARVAVAAGSLAPPVLPPPIQRLRGCSMFYVFLNEDPSDGSSPIPDSGSPSGPRAAPEHPARLPLTSRTFFFLTKTRSQAVPCPPPPIPAGPVRTRASCVVIVAWRVPIPPM

SEQ ID NO: 754495 - protein, 710 aa, Homo sapiens
SAALPCAEARGPGTSAGSEQKERGPGPGQGSPGGGPGPRSLSGPEQGTACCELEEAQGQCQQEEAQREAASVPLRDSGHPGHAEGREGDFPAADLDSLWEDFSQSLARGNSELLAFLTSSGAGSQPEAQRELDVVLRTVIPKTSPHCPLTTPRREIVVQDVLNGTITFLPLEEDDEGNLKVKMSNVYQIQLSHSKEEWFISVLIFCPERWHSDGIVYPKPTWLGEELLAKLAKWSVENKKSDFKSTLSLISIMKYSKAYQELKEKYKEMVKVWPEVTDPEKFVYEDVAIAAYLLILWEEERAERGLTARQSFVDLGCGNGLLVHILSSEGHPGRGIDVRRRKIWDMYGPQTQLEEDAITPNDKTLFPDVDWLIGNHSDELTPWIPVIAARSSYNCRFFVLPCCFFDFIGRYSRRQSKKTQYREYLDFIKEVGFTCGFHVDEDCLRIPSTKRVCLVGKSRTYPSSREASVDEKRTQYIKSRRGCPVSPPGWELSPSPRWVAAGSAGHCDGQQALDARVGCVTRAWAAEHGAGPQAEGPWLPGFHPREKAERVRNCAALPRDFIDQVVLQVANLLLGGKQLNTRSSRNGSLKTWNGGESLSLAEVANELDTETLRRLKRECGGLQTLLRNSHQVFQVVNGRVHIRDWREETLWKTKQPEAKQRLLSEACKTRLCWFFMHHPDGCALSTDCCPFAHGPAELRPPRTTPRKKIS

SEQ ID NO: 754496 - protein, 710 aa, Homo sapiens; identical to SEQ ID NO: 754495

SEQ ID NO: 754497 - protein, 120 aa, Homo sapiens
MGEFTSATGERRHCGRQSNRKRNRDCSLKPAKPASAGSSCITLMAALCPRTAARLPMGLRSCGHPGPPRGRRFHELHPCQPRPGWGGQTKESFPSSRQCCGLCSGCVSAHLLPAFSTSSQ

SEQ ID NO: 754498 - protein, 120 aa, Homo sapiens; identical to SEQ ID NO: 754497

SEQ ID NO: 754499 - protein, 662 aa, Homo sapiens
SAALPCAEARGPGTSAGSEQKERGPGPGQGSPGGGPGPRSLSGPEQGTACCELEEAQGQCQQEEAQREAASVPLRDSGHPGHAEGREGDFPAADLDSLWEDFSQSLARGNSELLAFLTSSGAGSQPEAQRELDVVLRTVIPKTSPHCPLTTPRREIVVQERWHSDGIVYPKPTWLGEELLAKLAKWSVENKKSDFKSTLSLISIMKYSKAYQELKEKYKEMVKVWPEVTDPEKFVYEDVAIAAYLLILWEEERAERGLTARQSFVDLGCGNGLLVHILSSEGHPGRGIDVRRRKIWDMYGPQTQLEEDAITPNDKTLFPDVDWLIGNHSDELTPWIPVIAARSSYNCRFFVLPCCFFDFIGRYSRRQSKKTQYREYLDFIKEVGFTCGFHVDEDCLRIPSTKRVCLVGKSRTYPSSREASVDEKRTQYIKSRRGCPVSPPGWELSPSPRWVAAGSAGHCDGQQALDARVGCVTRAWAAEHGAGPQAEGPWLPGFHPREKAERVRNCAALPRDFIDQVVLQVANLLLGGKQLNTRSSRNGSLKTWNGGESLSLAEVANELDTETLRRLKRECGGLQTLLRNSHQVFQVVNGRVHIRDWREETLWKTKQPEAKQRLLSEACKTRLCWFFMHHPDGCALSTDCCPFAHGPAELRPPRTTPRKKIS

SEQ ID NO: 754500 - protein, 120 aa, Homo sapiens; identical to SEQ ID NO: 754497

SEQ ID NO: 754501 - protein, 605 aa, Homo sapiens
SAALPCAEARGPGTSAGSEQKERGPGPGQGSPGGGPGPRSLSGPEQGTACCELEEAQGQCQQEEAQREAASVPLRDSGHPGHAEGREGDFPAADLDSLWEDFSQSLARGNSELLAFLTSSGAGSQPEAQRELDVVLRTVIPKTSPHCPLTTPRREIVVQDVLNGTITFLPLEEDDEGNLKVKMSNVYQIQLSHSKEEWFISVLIFCPERWHSDGIVYPKPTWLGEELLAKLAKWSVENKKSDFKSTLSLISIMKYSKAYQELKEKYKEMVKVWPEVTDPEKFVYEDVAIAAYLLILWEEERAERGLTARQSFVDLGCGNGLLVHILSSEGHPGRGIDVRRRKIWDMYGPQTQLEEDAITPNDKTLFPDVDWLIGNHSDELTPWIPVIAARSSYNCRFFVLPCCFFDFIGRYSRRQSKKTQYREYLDFIKEVGFTCGFHVDEDCLRIPSTKRVCLVGKSRTYPSSREASVDEKRTQYIKSRRGCPVSPPGWELSPSPRWVAAGSAGHCDGQQALDARVGCVTRAWAAEHGAGPQAEGPWLPGFHPREKAERVRNCAALPRDFIDQVVLQVANLLLGGKQLNTRSSRNGSLKTWNGGGKLSTILGRG

SEQ ID NO: 754502 - protein, 1025 aa, Homo sapiens
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPENIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 754503 - protein, 1025 aa, Homo sapiens; identical to SEQ ID NO: 754502

SEQ ID NO: 754504 - protein, 1025 aa, Homo sapiens; identical to SEQ ID NO: 754502

SEQ ID NO: 754505 - protein, 83 aa, Homo sapiens
GRMDTSTFRRENRRLDNLLVLSATLVPPSAVSEDEATLLLPELRRFGWGKTASSIEMVPSGVLYHTKYCCWINLPVFNKDTFI

SEQ ID NO: 754506 - protein, 1025 aa, Homo sapiens; identical to SEQ ID NO: 754502

SEQ ID NO: 754507 - protein, 854 aa, Homo sapiens
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPENIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQR

SEQ ID NO: 754508 - protein, 668 aa, Homo sapiens
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPENIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTRYMPSFFSCHLFCTLRWKYF

SEQ ID NO: 754509 - protein, 1011 aa, Homo sapiens
MIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPENIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 754510 - protein, 717 aa, Homo sapiens
MTQVLVEQVFSLQRDLLEYKRVIILDFKKELEILSCGRNVYALEIYKSYECRNEISPVCSVNIKWLDILNCKKYQLHHKLGPSSILFYLSLFKGNFVVIVSAFMNFLTITGSTLIFLAICVSILWDISHHRNTRVVRRLLGVQSKSSCISIIGYQTESFLLGNKKSVKCWLGAVAYACNPSILGCQGGQPFEARSSKPVWPTWQNPISTKNIKISWAWWCTPVIPAPGRHENHLNPGGGGCSEPRLCHCTPAWVTKRDCLKKQKTKKKELSVDFVGLLQFVEMDFKKSLFKPKYLEPSSAIRLLNIHIIPMFHGASGKANTSEMSHLQGQHFLGCKTRCGFCYLGLSKNWGHGYDIAFLLTYAFVTFVFIGIKSLFKELPSPFIPFVFLKTKLYIYLLVFAFFYFVLHSLLCQLSTTCKVAVQKYGKSPPLTLLPVWVTANGKVDRFFSVVFLGVYTLKMYIHVFDSFYIISFCIFFFLMKSDISSYENFIYPSHFTCMGSSYRLVIWFPSLEEGGDVERRASYILLKVCTDVFAILCYFILYFIHPFCGRVDKTRWSKSMTDVPFAFLLIVRMDNNCQSSPSCCCFDLVLGLGLYIILSSVYKYCATFLYFILYLFPCMDAYILNENGGSEYDKSLFPFPYCLFEAIANRVVCFVLGCGGEWSMYLMYINKLATTLYYYIWFTLCPSHGCESTNEMWRSRCITVSHSPHPLLTAGQ

SEQ ID NO: 754511 - protein, 1025 aa, Homo sapiens; identical to SEQ ID NO: 754502

SEQ ID NO: 754512 - protein, 953 aa, Homo sapiens
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPENIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWYEITEEYDIQKPKEYKHCALGQELIFEGISFPHFCYRPGLSWTVW

SEQ ID NO: 754513 - protein, 287 aa, Homo sapiens [sequence omitted]

SEQ ID NO: 754514 - protein, 1226 aa, Homo sapiens
MEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPTQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFSCPKSGGDKSRAPTLCLVCGSLLCSQSYCCQTELEGEDVGACTAHTYSCGSGVGIFLRVRECQVLFLAGKTKGCFYSPPYLDDYGETDQGLRRGNPLHLCKERFKKIQKLWHQHSVTEEIGHAQEANQTLVGIDWQHL

SEQ ID NO: 754515 - protein, 1257 aa, Homo sapiens
MLGESRGCAFDTKCMRMITTPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPTQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFSCPKSGGDKSRAPTLCLVCGSLLCSQSYCCQTELEGEDVGACTAHTYSCGSGVGIFLRVRECQVLFLAGKTKGCFYSPPYLDDYGETDQGLRRGNPLHLCKERFKKIQKLWHQHSVTEEIGHAQEANQTLVGIDWQHL

SEQ ID NO: 754516 - protein, 710 aa, Homo sapiens [sequence omitted]

SEQ ID NO: 754517 - protein, 1017 aa, Homo sapiens
MLGESRGCAFDTKCMRMITTPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPTQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRKYGNVRCYF

SEQ ID NO: 754518 - protein, 1257 aa, Homo sapiens; identical to SEQ ID NO: 754515

SEQ ID NO: 754519 - protein, 1257 aa, Homo sapiens; identical to SEQ ID NO: 754515

SEQ ID NO: 754520 - protein, 1120 aa, Homo sapiens
MLGESRGCAFDTKCMRMITTPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPTQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFS

SEQ ID NO: 754521 - protein, 735 aa, Homo sapiens
MLGESRGCAFDTKCMRMITTPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPTQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNK

SEQ ID NO: 754522 - protein, 767 aa, Homo sapiens
MTRKFVKRSIFLKMRESSPTSPVAETEGTIMEESSRDKDKAERKRKAEIARLRREKIMAQMSEMQRHFIDENKELFQQTLELDASTSAVLDHSPVASDMTLTALGPTQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFSCPKSGGDKSRAPTLCLVCGSLLCSQSYCCQTELEGEDVGACTAHTYSCGSGVGIFLRVRECQVLFLAGKTKGCFYSPPYLDDYGETDQGLRRGNPLHLCKERFKKIQKLWHQHSVTEEIGHAQEANQTLVGIDWQHL

SEQ ID NO: 754523 - protein, 1257 aa, Homo sapiens; identical to SEQ ID NO: 754515

SEQ ID NO: 754524 - protein, 452 aa, Homo sapiens
MLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFSCPKSGGDKSRAPTLCLVCGSLLCSQSYCCQTELEGEDVGACTAHTYSCGSGVGIFLRVRECQVLFLAGKTKGCFYSPPYLDDYGETDQGLRRGNPLHLCKERFKKIQKLWHQHSVTEEIGHAQEANQTLVGIDWQHL

SEQ ID NO: 754525 - protein, 1257 aa, Homo sapiens; identical to SEQ ID NO: 754515

SEQ ID NO: 754526 - protein, 681 aa, Homo sapiens
MLGESRGCAFDTKCMRMITTPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPTQTQVPEQRQFVTCILCQEEQEVKVESRAMVLAAFVQRSTVLSKNRSKFIQDPEKYDPLFMHPDLSCGTHTSSCGHIMHAHCWQR

SEQ ID NO: 754527 - protein, 652 aa, Homo sapiens
MLGESRGCAFDTKCMRMITTPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPTQTQVPEQRQFVTCILCQEEQEVKVESRAMVLAAFVQRSTVLSKNRSKFIQDPGKS

SEQ ID NO: 754528 - protein, 338 aa, Homo sapiens
SGGGGGGGGGGIVRAPAARPGRSRTRRGRLLPHGPMNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLDGKAPEGSPHGGSVRSRYSGTWIFDQALRYASGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPMNNITSDIFKKKEVRQCQKRETGNYTCEFCGKQYKYYTPYQEHVALHAPISE

SEQ ID NO: 754529 - protein, 318 aa, Homo sapiens
SGGGGGGGGGGIVRAPAARPGRSRTRRGRLLPHGPMNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLDGKAPEGSPHGGSVRSRYSGTWIFDQALRYASGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPKTGNYTCEFCGKQYKYYTPYQEHVALHAPISE

SEQ ID NO: 754530 - protein, 374 aa, Homo sapiens
HASGRPQSRGTMAPAGRPGAKKGILERLESGEVVIGDGSFLITLEKRGYVKAGLWTPEAVIEHPDAVRQLHMEFLRAGSNVMQTFTFSASEDNMESKWEDVNAAACDLAREVAGKGDALVAGGICQTSIYKYQKDEARIKKLFRQQLEVFAWKNVDFLIAEYFEHVEEAVWAVEVLKESDRPVAVTMCIGPEGDMHDITPGECAVRLVKAGASIVGVNCRFGPDTSLKTMELMKEGLEWAGLKAHLMVQPLGFHAPDCGKEGFVDLPEYPFGLESRVATRWDIQKYAREAYNLGVRYIGGCCGFEPYHIRAIAEELAPERGFLPPASEKHGSWGSGLDMHTKPWIRARARREYWENLLPASGRPFCPSLSKPDF

SEQ ID NO: 754531 - protein, 107 aa, Homo sapiens
PRVRAPTEPRHHGTCWTPGGQEGEFRPLDPRGAPGRWAASDSVHTRRSSLAKPWGLGKTLGRDGPEPQFSPVTGWLAFMEPLLGAWRCTECCAQVISSSSQLSPFHR

SEQ ID NO: 754532 - protein, 374 aa, Homo sapiens; identical to SEQ ID NO: 754530

SEQ ID NO: 754533 - protein, 291 aa, Homo sapiens
HASGRPQSRGTMAPAGRPGAKKGILERLESGEVVIGDGSFLITLEKRGYVKAGLWTPEAVIEHPDAVRQLHMEFLRAGSNVMQTFTFSASEDNMESKWEDVNAAACDLAREVAGKGDALVAGGICQTSIYKYQKDEARIKKLFRQQLEVFAWKNVDFLIAEYFEHVEEAVWAVEVLKESDRPVAVTMCIGPEGDMHDITPGECAVRLVKAGASIVGVNCRFGPDTSLKTMELMKEGLEWAGLKAHLMVQPLGFHAPDCGKEGFVDLPEYPFGKLRCIVEVLVFLVTKSKWL

SEQ ID NO: 754534 - protein, 150 aa, Homo sapiens
MAPAGRPGAKKGILERLESGEVVIGDGSFLITLEKRGYVKAGLWTPEAVIEHPDAVRQLHMEFLRAGSNVMQTFTFSASEDNMESKWEDVNAAACDLAREVAGKGDALVAGGICQTSIYKYQKDEALKPDLEPFLTFILTMPCYLQLLSS

SEQ ID NO: 754535 - protein, 205 aa, Homo sapiens
HASGRPQSRGTMAPAGRPGAKKGILERLESGEVVIGDGSFLITLEKRGYVKAGLWTPEAVIEHPDAVRQLHMEFLRAGSNVMQTFTFSASEDNMESKWEDVNAAACDLAREVAGKGDALVAGGICQTSIYKYQKDEARIKKLFRQQLEVFAWKNVDFLIAEYFEHVEEAVWAVEVFMHDITPGECAVKLVARAFIGVLPLWPHTA

SEQ ID NO: 754536 - protein, 374 aa, Homo sapiens; identical to SEQ ID NO: 754530

SEQ ID NO: 754537 - protein, 374 aa, Homo sapiens; identical to SEQ ID NO: 754530

SEQ ID NO: 754538 - protein, 162 aa, Homo sapiens
MGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGLEMLERVRSQPLTNDDLVTSISVPPYTGDLSLAPRISGTVCLSVPQPSPYQVIGCSGFHLSSLYP

SEQ ID NO: 754539 - protein, 248 aa, Homo sapiens
RARLARPRREPGPLEGSGARPRRYRCLLTIGQACSRCRRRRRRRPTQGVAQACGAPPSPPSFLPSKPSLGYLTPLWSRTRSEQSMDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGLEMLERVRSQPLTNDDLVTSISVPPYTGDLSLAPRISGTVCLSVPQPSPYQVIGCSGFHLSSLYP

SEQ ID NO: 754540 - protein, 279 aa, Homo sapiens
SSAPRAAAARAGTPGRVGCAAQEVPLSPHNRPGLQPLPPLPPPPPPPPPPYSGSGPGLRRATLTSFIPTVKAQPWLPDPPVVSNSDYLLCGIISSLVESVSCVSAREHPIWSEQSMDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGLEMLERVRSQPLTNDDLVTSISVPPYTGDLSLAPRISGTVCLSVPQPSPYQVIGCSGFHLSSLYP

SEQ ID NO: 754541 - protein, 285 aa, Homo sapiens
RVDAMMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGSKDESAFMVHPLTAQGVAVVIVAYGIAPKGTLDHMVDQVTRSVAFVQKRYPSNKGIYLCGHSAGAHLAAMMLLADWTKHGVTPNLRGFFLVSGVFDLEPIVYTSQNVALQLTLEDAQRNSPQLKVAQAQPVDPTCRVLVVVGQFDSPEFTSPGFSRAPGAREGERLRARGPYWIPRVAL

SEQ ID NO: 754542 - protein, 107 aa, Homo sapiens
RVDAMMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGR

SEQ ID NO: 754543 - protein, 231 aa, Homo sapiens
MVDQVTRSVAFVQKRYPSNKWVLPVDFLPVGPQWVGGQCNQYLGYSQAAPLACGAESKLGLFEGGLMLWGNCVQIQLSALTPPRGIYLCGHSAGAHLAAMMLLADWTKHGVTPNLRGFFLVSGVFDLEPIVYTSQNVALQLTLEDAQRNSPQLKVAQAQPVDPTCRVLVVVGQFDSPEFHRQSWEFYQTLCQGEWKASFEELHDVDHFEIVENLTQKDNVLTQIILKTIFQ

SEQ ID NO: 754544 - protein, 231 aa, Homo sapiens; identical to SEQ ID NO: 754543

SEQ ID NO: 754545 - protein, 400 aa, Homo sapiens
RVDAMMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGSKDESAFMVHPLTAQGVAVVIVAYGIAPKGNRSGCCRSEGRWALGGSASLTQLMLSVQGTLDHMVDQVTRSVAFVQKRYPSNKWVLPVDFLPVGPQWVGGQCNQYLGYSQAAPLACGAESKLGLFEGGLMLWGNCVQIQLSALTPPRGIYLCGHSAGAHLAAMMLLADWTKHGVTPNLRGFFLVSGVFDLEPIVYTSQNVALQLTLEDAQRNSPQLKVAQAQPVDPTCRVLVVVGQFDSPEFHRQSWEFYQTLCQGEWKASFEELHDVDHFEIVENLTQKDNVLTQIILKTIFQ

SEQ ID NO: 754546 - protein, 115 aa, Homo sapiens
RVDAMMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGRLFPGEWGL

SEQ ID NO: 754547 - protein, 131 aa, Homo sapiens
MGEGEEAHSVEKESLTEPHVCALQELENQYCPSRWVVRLGAEEALRTYSQIGIEATTRARATRKSLLHVPYGDGEGEKVDIYFPDESSEALPFFLFFHGGYWQSGRPCVKESGKPHLKSSTMWTTLKLLRI

SEQ ID NO: 754548 - protein, 108 aa, Homo sapiens
MGEGEEAHSVEKESLTEPHVCALQELENQYCPSRWVVRLGAEEALRTYSQIGIEATTRARATRKSLLHVPYGDGEGEKVDIYFPDESSEALPFFLFFHGGYWQSGRLS

SEQ ID NO: 754549 - protein, 88 aa, Homo sapiens
RVDAMMDVSGVGFPSKVPWKKMSAEELENQYCPSRWVVRLGAEEALRTYSQIGIEDYLENNLPVVLTILGAWSTCIPPWEASPKSFRS

SEQ ID NO: 754550 - protein, 231 aa, Homo sapiens; identical to SEQ ID NO: 754543

SEQ ID NO: 754551 - protein, 157 aa, Homo sapiens [sequence omitted]

SEQ ID NO: 754552 - protein, 153 aa, Homo sapiens
MSPMETAKGRKWTFTSPTSRLKPCLSSCSFTEDTGRAEGFFLVSGVFDLEPIVYTSQNVALQLTLEDAQRNSPQLKVAQAQPVDPTCRVLVVVGQFDSPEFHRQSWEFYQTLCQGEWKASFEELHDVDHFEIVENLTQKDNVLTQIILKTIFQ

SEQ ID NO: 754553 - protein, 75 aa, Homo sapiens
TDKALIRPTHRLELKPAVLPVLTRDAYVAERKTLCQGEWKASFEELHDVDHFEIVENLTQKDNVLTQIILKTIFQ

SEQ ID NO: 754554 - protein, 558 aa, Homo sapiens
MYRYLAKALLPSRAGPAALGSAANHSAALLGRGRGQPAAASQPGLALAARRHYSELVADREDDPNFFKMVEGFFDRGASIVEDKLVKDLRTQESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTENELEKITRRFTMELAKKGFIGPGVDVPAPDMNTGEREMSWIADTYASTIGHYDINAHACVTGKPISQGGIHGRISATGRGVFHGIENFINEASYMSILGMTPGFRDKTFVVQGFGNVGLHSMRYLHRFGAKCIAVGESDGSIWNPDGIDPKELEDFKLQHGSILGFPKAKPYEGSILEVDCDILIPAATEKQLTKSNAPRVKAKIIAEGANGPTTPEADKIFLERNILVIPDLYLNAGGVTVSYFEWLKNLNHVSYGRLTFKYERDSNYHLLLSVQESLERKFGKHGGTIPIVPTAEFQDSISGASEKDIVHSALAYTMERSARQIMHTAMKYNLGLDLRTAAYVNAIEKVFKVYSEAGVTFT

SEQ ID NO: 754555 - protein, 226 aa, Homo sapiens
SSGINAECPLRPGTLLSAFFSPHPSLYLQPPMAPKKPEPKKDDAKAAPKAAPAPAPPPEPERPKEVEFDASKIKIEFTPEQIEEFKEAFMLFDRTPKCEMKITYGQCGDVLRALGQNPTQAEVLRVLGKPRQEELNTKMMDFETFLPMLQHISKNKDTGTYEDFVEGLRVFDKEGNGTVMGAELRHVLATLGERLTEDEVEKLMAGQEDSNGCINYEAFVKHIMSS

SEQ ID NO: 754556 - protein, 195 aa, Homo sapiens
MAPKKPEPKKDDAKAAPKAAPAPAPPPEPERPKEVEFDASKIKIEFTPEQIEEFKEAFMLFDRTPKCEMKITYGQCGDVLRALGQNPTQAEVLRVLGKPRQEELNTKMMDFETFLPMLQHISKNKDTGTYEDFVEGLRVFDKEGNGTVMGAELRHVLATLGERLTEDEVEKLMAGQEDSNGCINYEAFVKHIMSS

SEQ ID NO: 754557 - protein, 195 aa, Homo sapiens; identical to SEQ ID NO: 754556

SEQ ID NO: 754558 - protein, 226 aa, Homo sapiens; identical to SEQ ID NO: 754555

SEQ ID NO: 754559 - protein, 171 aa, Homo sapiens
MAPKKPEPKKDDAKAAPKAAPAPAPPPEPERPKEVEFDASKIKIEFTPEQIEEFKEAFMLFDRTPKCEMKITYGQCGDVLRALGQNPTQAEVLRVLGKPRQEELNTKMMDFETFLPMLQHISKNKDTGTYEDFVEGLRVFDKEGNGTVMGAELRHVLATLGERLVQEGRKL

SEQ ID NO: 754560 - protein, 74 aa, Homo sapiens
SAPSLLCRALGEVHTGKAASFTPRCRRALAGWVPEEMFSLHFVIVSVMDTDDDVLAPYHECSLQFAARVTRASC

SEQ ID NO: 754561 - protein, 309 aa, Homo sapiens
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGSPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 754562 - protein, 309 aa, Homo sapiens; identical to SEQ ID NO: 754561

SEQ ID NO: 754563 - protein, 121 aa, Homo sapiens
KPQSLPEPPQPQPGPPLPGPSPLCSSHTCLPWCGQACSCTGVLSVPSVPSIHDADTSLHPPGPTQTLLLRKTPGNSPSWTSSPPATLQLAGAIAVSLGVVTQCPTHLPPIGPSYNMLDNMC

SEQ ID NO: 754564 - protein, 104 aa, Homo sapiens
LYLLIRFVNNVYFFCYKFIIIITWTGRFSGLHPHQWGALLAHSQFAGLRTGPARSPPAQNERADSPWTHEATAPRGENGGLIPPALGEDDSLGGGQGSECYPGA

SEQ ID NO: 754565 - protein, 164 aa, Homo sapiens
MRIFAPNHVVAKSCFWYLVSQLKKMKKSSGEIATVGRVFEKLPLRVKNFGIWLHCDAQSSTHNMCREYGDLNHRGCCHPVLPRHGRLAPRPGPLRPDHEGGGDHSQQVPRQPSSSSMTPRSNSCCPTRYCTIRTSHTSPRGPTPSSKAGPSPGCAPNKLRNAPV

SEQ ID NO: 754566 - protein, 613 aa, Homo sapiens
LEAAHAGSQELIDGFSGILEPERHVRVKQRTSVLNMLRRLDKIRFRGHKRDDFLDLAESPNASDTECSDEIPLKVPRTSPRDSEELRDPAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVGLYAGIKFFLIDFIFKRCPRLRAKYDTPYIIWRSLPTDPQLKERSSAAVSRRLQTTSSRSYVPSAPAGLGKEEDAGRFHSTKKGNFHEIFNLTENERPLAVCENGWRCCLINRDRKMPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 754567 - protein, 602 aa, Homo sapiens
WGGRIQVWSLWIERLEMPVGLPREPERHVRVKQRTSVLNMLRRLDKIRFRGHKRDDFLDLAESPNASDTECSDEIPLKAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVGLYAGIKFFLIDFIFKRCPRLRAKYDTPYIIWRSLPTDPQLKERSSAAVSRRLQTTSSRSYVPSAPAGLGKEEDAGRFHSTKKGNFHEIFNLTENERPLAVCENGWRCCLINRDRKMPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 754568 - protein, 533 aa, Homo sapiens
PNSSQPSSWAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVGLYAGIKFFLIDFIFKRCPRLRAKYDTPYIIWRSLPTDPQLKERSSAAVSRRLQTTSSRSYVPSAPAGLGKEEDAGRFHSTKKGNFHEIFNLTENERPLAVCENGWRCCLINRDRKMPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 754569 - protein, 490 aa, Homo sapiens
PNSSQPSSWAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVGLYAGIKFFLIDFIFKRCPRLRAKYDTPYIIWRSLPTDPQLKERSSAAVSRRLQTTSSRSYVPSAPAGLGKEEDAGRFHSTKKGNFHEIFNLTENERPLAVCENGWRCCLINRDRKMPTDYIRNGVLYVTENYLCFESSKSGSSKRNKVIKLVDITDIQKVNHHHRSVEAAGTK

SEQ ID NO: 754570 - protein, 617 aa, Homo sapiens
WGGRIQVWSLWIERLEMPVGLPREPERHVRVKQRTSVLNMLRRLDKIRFRGHKRDDFLDLAESPNASDTECSDEIPLKVPRTSPRDSEELRDPAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVGLYAGIKFFLIDFIFKRCPRLRAKYDTPYIIWRSLPTDPQLKERSSAAVSRRLQTTSSRSYVPSAPAGLGKEEDAGRFHSTKKGNFHEIFNLTENERPLAVCENGWRCCLINRDRKMPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 754571 - protein, 533 aa, Homo sapiens; identical to SEQ ID NO: 754568

SEQ ID NO: 754572 - protein, 533 aa, Homo sapiens; identical to SEQ ID NO: 754568

SEQ ID NO: 754573 - protein, 355 aa, Homo sapiens
PNSSQPSSWAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVVLTRDLSLEGQRLPAPSKDGPSWDLGSLELSCPSWVGHH

SEQ ID NO: 754574 - protein, 105 aa, Homo sapiens
MSSSSVWRTGLARDYRSHRLRAQPRKDPKTPSCVGVSWESRPGKGLCSHPVLLKSEICPQNPWNQEAQLCPPPGALGSTSAGRETPGITEGQLGWGWSQEAVMGS

SEQ ID NO: 754575 - protein, 449 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 754576 - protein, 201 aa, Homo sapiens
TSFPAFGRGPGRARCPELPGLRCRPRPRAGPQAPSYCPRATRPPGACCARVRGSHCRPGSCCQGSLTGLGLRDRGWGAGGGLDGGTRGSGRVSGAERGRRNGTGGAADGARTECKTLSNADASVTRVESLPSSHMCHKGWHGPGVPHHVAFTPCKARLRPATQCQAHSSPRRKMVQAGSIPLAAASGRLCLTHAGWWRGAS

SEQ ID NO: 754577 - protein, 127 aa, Homo sapiens
VISGVWAGPGQGALPGAAWVALPATSPRRASGSFLLSEGHQAAGGLLRPDASVTRVESLPSSHMCHKGWHGPGVPHHVAFTPCKARLRPATQCQAHSSPRRKMVQAGSIPLAAASEMGFRHVAQAGL

SEQ ID NO: 754578 - protein, 450 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVTTPPPPPPPTPTKP

SEQ ID NO: 754579 - protein, 449 aa, Homo sapiens; identical to SEQ ID NO: 754575

SEQ ID NO: 754580 - protein, 449 aa, Homo sapiens; identical to SEQ ID NO: 754575

SEQ ID NO: 754581 - protein, 322 aa, Homo sapiens
KLLSKVRTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 754582 - protein, 154 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSL

SEQ ID NO: 754583 - protein, 114 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDAYESYKKKDYTQVDYLINGMYADSEM

SEQ ID NO: 754584 - protein, 130 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAPQDRPTQQAANRDP

SEQ ID NO: 754585 - protein, 113 aa, Homo sapiens
MAWPGSAPPRGFHPLQSQTSPSDTVSSPQLSKEEDGPGWEHPLSSSLWEAVSYSCRVVEGRLLAEDDERLSPLRKEKVLVCSKAKNWTRRRRFIQYIESDPPCCSWSTVPEAG

SEQ ID NO: 754586 - protein, 449 aa, Homo sapiens; identical to SEQ ID NO: 754575

SEQ ID NO: 754587 - protein, 449 aa, Homo sapiens; identical to SEQ ID NO: 754575

SEQ ID NO: 754588 - protein, 449 aa, Homo sapiens; identical to SEQ ID NO: 754575

SEQ ID NO: 754589 - protein, 209 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSRRRAEVDKSCR

SEQ ID NO: 754590 - protein, 289 aa, Homo sapiens
ALAFSIGLGENPNEHKNPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 754591 - protein, 114 aa, Homo sapiens; identical to SEQ ID NO: 754583

SEQ ID NO: 754592 - protein, 114 aa, Homo sapiens; identical to SEQ ID NO: 754583

SEQ ID NO: 754593 - protein, 632 aa, Homo sapiens
QCPRSVELHSGILTRPCNRWATVPATEMVEGPGCTLNGEKIRARVLPGQAVTGVRGSALRSLQGRALRLAASTVVVSPQAAALNNDSSQNVLSLFNGYVYSGVETLGKELFMYFGPKALRIHFGMKGFIMINPLEYKYKNGASPVLEVQLTKDLICFFDSSVELRNSMESQQRIRMMKELDVCSPEFSFLRAESEVKKQKGRMLGDVLMDQNVLPGVGNIIKNEALFDSGLHPAVKVCQLTDEQIHHLMKMIRDFSILFYRCRKAGLALSKHYKVYKRPNCGQCHCRITVCRFGDNNRMTYFCPHCQKENPQHVDICKLPTRNTIISWTSSRVDHVMDSVARKSEEHWTCVVCTLINKPSSKACDACLTSRPIDSVLKSEENSTVFSHLMKYPCNTFGKPHTEVKINRKTAFGTTTLVLTDFSNKSSTLERKTKQNQILDEEFQNSPPASVCLNDIQHPSKKTTNDITQLSSKVNISPTISSESKLFSPAHKKPKTAHYSSPELKSCNPGYSNSELQINMTDGPRTLNPDSPRCSKHNRLCILRVVRKDGENKGRQFYACPLPREAQCGFFEWADLSFPFCNHGKRSTMKTVLKIGPNNGKNFFVCPLGKEKQCNFFQWAENGPGIKIIPGC

SEQ ID NO: 754594 - protein, 378 aa, Homo sapiens
QCPRSVELHSGILTRPCNRWATVPATEMVEGPGCTLNGEKIRARVLPGQAVTGVRGSALRSLQGRALRLAASTVVVSPQAAALNNDSSQNVLSLFNGYVYSGVETLGKELFMYFGPKALRIHFGMKGFIMINPLEYKYKNGASPVLEVQLTKDLICFFDSSVELRNSMESQQRIRMMKELDVCSPEFSFLRAESEVKKQKGRMLGDVLMDQNVLPGVGNIIKNEALFDSGLHPAVKVCQLTDEQIHHLMKMIRDFSILFYRCRKAGLALSKHYKVYKRPNCGQCHCRITVCRFGDNNRMTYFCPHCQKENPQHVDICKLPTRNTIISWTSSRVDHVMDSVARKSEEHWTCVVCTLINKPSSKACDACLTSRPIGKTEF

SEQ ID NO: 754595 - protein, 309 aa, Homo sapiens
QCPRSVELHSGILTRPCNRKSEEHWTCVVCTLINKPSSKACDACLTSRPIDSVLKSEENSTVFSHLMKYPCNTFGKPHTEVKINRKTAFGTTTLVLTDFSNKSSTLERKTKQNQILDEEFQNSPPASVCLNDIQHPSKKTTNDITQLSSKVNISPTISSESKLFSPAHKKPKTAHYSSPELKSCNPGYSNSELQINMTDGPRTLNPDSPRCSKHNRLCILRVVRKDGENKGRQFYACPLPREAQCGFFEWADLSFPFCNHGKRSTMKTVLKIGPNNGKNFFVCPLGKEKQCNFFQWAENGPGIKIIPGC

SEQ ID NO: 754596 - protein, 137 aa, Homo sapiens
YRLLRTSLLMLGGLDGTKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPVHGGSSRVDA

SEQ ID NO: 754597 - protein, 459 aa, Homo sapiens
MRSAVFKAAAAPAGGNPEQRLDYERAAALGGPEDEPGAAEAHFLPRHRKLKEPGPPLASSQGGSPAPSPAGCGGKGRGLLLPAGAAPGQQEESWGGSVPLPCPPPATKQAGIGGEPAAAGAGCSPRPKYQAVLPIQTGSLVAAAKEPTPWAGDKGGAASPAATASDPAGPPPLPLPGPPPLAPTATAGTLAASEGRWKSMRKSPLGGGGGSGASSQAACLKQILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVASKA

SEQ ID NO: 754598 - protein, 284 aa, Homo sapiens
MRSAVFKRPRPLPAAILSSDWTTSGLRRWAGPRTSLGRPKPTSSPGTILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVASKA

SEQ ID NO: 754599 - protein, 138 aa, Homo sapiens [sequence omitted]

SEQ ID NO: 754600 - protein, 389 aa, Homo sapiens
MRSAVFKAAAAPAGGNPEQRLDYERAAALGGPEDEPGAAEAHFLPRHRKLKEPGPPLASSQGGSPAPSPAGCGGKGRGLLLPAGAAPGQQEESWGGSVPLPCPPPATKQAGIGGEPAAAGAGCSPRPKYQAVLPIQTGSLVAAAKEPTPWAGDKGGAASPAATASDPAGPPPLPLPGPPPLAPTATAGTLAASEGRWKSMRKSPLGGGGGSGASSQAACLKQILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKSKGNPIWRQDGRLPFKAWFRILKSKNKLPRLFYYKRNLGVLFESVDGMGATSPFPAFGGPP

SEQ ID NO: 754601 - protein, 372 aa, Homo sapiens
MRSAVFKAAAAPAGGNPEQRLDYERAAALGGPEDEPGAAEAHFLPRHRKLKEPGPPLASSQGGSPAPSPAGCGGKGRGLLLPAGAAPGQQEESWGGSVPLPCPPPATKQAGIGGEPAAAGAGCSPRPKYQAVLPIQTGSLVAAAKEPTPWAGDKGGAASPAATASDPAGPPPLPLPGPPPLAPTATAGTLAASEGRWKSMRKSPLGGGGGSGASSQAACLKQILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKRKSPFGSTERKILNFQKSKQKLLSTLLLKRNPVVPYLKLFVNVN

SEQ ID NO: 754602 - protein, 459 aa, Homo sapiens; identical to SEQ ID NO: 754597

SEQ ID NO: 754603 - protein, 469 aa, Homo sapiens
MRSAVFKAAAAPAGGNPEQRLDYERAAALGGPEDEPGAAEAHFLPRHRKLKEPGPPLASSQGGSPAPSPAGCGGKGRGLLLPAGAAPGQQEESWGGSVPLPCPPPATKQAGIGGEPAAAGAGCSPRPKYQAVLPIQTGSLVAAAKEPTPWAGDKGGAASPAATASDPAGPPPLPLPGPPPLAPTATAGTLAASEGRWKSMRKSPLGGGGGSGASSQAACLKQILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSLRLQTQRGRKATTTTKSPRKP

SEQ ID NO: 754604 - protein, 1980 aa, Homo sapiens
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 754605 - protein, 1980 aa, Homo sapiens; identical to SEQ ID NO: 754604

SEQ ID NO: 754606 - protein, 1663 aa, Homo sapiens
MLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 754607 - protein, 411 aa, Homo sapiens
EAGPAPLSAAAPGAGRGWPRPLAERRKGRGRRQPLRARLNRRRWAAGQGSTVQAATFGPAMAAAPLKVCIVGSGNWGSAVAKIIGNNVKKLQKFASTVKMWVFEETVNGRKLTDIINNDHENVKYLPGHKLPENVVAMSNLSEAVQDADLLVFVIPHQFIHRICDEITGRVPKKALGITLIKGIDEGPEGLKLISDIIREKMGIDISVLMGANIANEVAAEKFCETTIGSKVMENGLLFKELLQTPNFRITVVDDADTVELCGALKNIVAVGAGFCDGLRCGDNTKAAVIRLGLMEMIAFARIFCKGQVSTATFLESCGVADLITTCYGGRNRRVAEAFARTGKTIEELEKEMLNGQKLQGPQTSAEVYRILKQKGLLDKFPLFTAVYQICYESRPVQEMLSCLQSHPEHT

SEQ ID NO: 754608 - protein, 352 aa, Homo sapiens
RSGSCPAVSCGPRRRAGVAATIGGEAKGAGPPPAAAGKAEQAEVGSRPGKHGPGGYIRPGHGSGAPESVHRGLGELVAMSNLSEAVQDADLLVFVIPHQFIHRICDEITGRVPKKALGITLIKGIDEGPEGLKLISDIIREKMGIDISVLMGANIANEVAAEKFCETTIGSKVMENGLLFKELLQTPNFRITVVDDADTVELCGALKNIVAVGAGFCDGLRCGDNTKAAVIRLGLMEMIAFARIFCKGQVSTATFLESCGVADLITTCYGGRNRRVAEAFARTGKTIEELEKEMLNGQKLQGPQTSAEVYRILKQKGLLDKFPLFTAVYQICYESRPVQEMLSCLQSHPEHT

SEQ ID NO: 754609 - protein, 352 aa, Homo sapiens; identical to SEQ ID NO: 754608

SEQ ID NO: 754610 - protein, 352 aa, Homo sapiens; identical to SEQ ID NO: 754608

SEQ ID NO: 754611 - protein, 50 aa, Homo sapiens
DIRGETVFSAFWLQVAMSNLSEAVQDADLLVFVIPHQFIHRICDEITGRV

SEQ ID NO: 754612 - protein, 352 aa, Homo sapiens; identical to SEQ ID NO: 754608

SEQ ID NO: 754613 - protein, 352 aa, Homo sapiens; identical to SEQ ID NO: 754608

SEQ ID NO: 754614 - protein, 72 aa, Homo sapiens
HLPCLGSCKGPGQNVAVTRAHPDSQGRRRRPELGARGGQVFYNSEYGELSEPSEEDHCSPSARVTFFTDNSY

SEQ ID NO: 754615 - protein, 83 aa, Homo sapiens
LVCRDGVLGRKNSKCQGCAGAGLCMCENKTENEGGGPTRSVGTDSSLCLWCHAEDSVLYVTDEGSKKTALTKARVQNQTQTQP

SEQ ID NO: 754616 - protein, 280 aa, Homo sapiens
SRDHICSSQNKVCSAAGQFTAKIPNLRAEPKPEERKVTIGPKPHSRFQMSFCSPRAINCCLLAAARSLGPYTACIKSLQRLGGWRWETDGGLRFVFPKFTASPGGGGCSEGPPRGQPTMKGFTATLFLWTLIFPSCSGGGGGKAWPTHVVCSDSGLEVLYQSCDPLQDFGFSVEKCSKQLKSNINIRFGIILREDIKELFLDLALMSQGSSVLNFSYPICEAALPKFSFCGRRKGEQIYYAGPVNNPEFTIPQGEYQVLLELYTEKRSTVACANATIMCS

SEQ ID NO: 754617 - protein, 280 aa, Homo sapiens; identical to SEQ ID NO: 754616

SEQ ID NO: 754618 - protein, 66 aa, Homo sapiens
RYQFEETLSVISCFSSDWLLWEEKQLMTERGSTKKRPQRVQLLILVPGPDIPRLHRCNEVPECICF

SEQ ID NO: 754619 - protein, 280 aa, Homo sapiens; identical to SEQ ID NO: 754616

SEQ ID NO: 754620 - protein, 112 aa, Homo sapiens
RLRELSRELSCPVAGFPKWGTRDEGGSTSRRCVVARRPGSRGARDSAAGPEREEWGRRPGVVHGPGGRGRWVWTWGRAPVSLQPMKDGKEGYRDRGRVGLRIARAAWHTVLG

SEQ ID NO: 754621 - protein, 764 aa, Homo sapiens [sequence omitted]

SEQ ID NO: 754622 - protein, 725 aa, Homo sapiens
CSSSSSRRAGAATAAGTRVPGAHGTMERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKMMNQVEGQQKDLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 754623 - protein, 331 aa, Homo sapiens
TGPEVHVSHQAGKEWTVLQVNVVFLEKIFGSIAEFQTDKVGITFLRQKRIDNHLRTRAPHGPPSGYSISKVKVTLNKFGQWLPCPSCDYGLEHPRMQSRQQRTETAATGTLQWFSSLRAQNSGTEGKFTGHVPLGVSSDEGKRVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 754624 - protein, 725 aa, Homo sapiens; identical to SEQ ID NO: 754622

SEQ ID NO: 754625 - protein, 423 aa, Homo sapiens
MPTPGGKEHRYYLSWNVGKEWSVWPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 754626 - protein, 396 aa, Homo sapiens
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKMMNQVEGQQKDLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPELAPEFGLRPELMTNKLTIDRSRQETGTCGVIGRIQRTYTFVHRHLHERQNFGNGTSTHRCVLSTPFYPCDERESFAWQHGYARLTVGDTPAPS

SEQ ID NO: 754627 - protein, 114 aa, Homo sapiens [sequence omitted]

SEQ ID NO: 754628 - protein, 39 aa, Homo sapiens
MKMPSHQLLLWALWTLETLVRATGGPRAARSTPRAPLCA

SEQ ID NO: 754629 - protein, 846 aa, Homo sapiens [sequence omitted]

SEQ ID NO: 754630 - protein, 846 aa, Homo sapiens [sequence omitted]

SEQ ID NO: 754631 - protein, 661 aa, Homo sapiens
MDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSRSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFKSSKFTRTISPPTLGTLRSCFSWSGGLGDFSRTPSPSPSTALQQFRRKSDSPTSLPENNMSDVSQLKSEESSDDESHPLREGACSSQSQESGEFSLQSSNASKLSQCSSKDSDSEESDCNIKLLDSQSDQTSKLCLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 754632 - protein, 718 aa, Homo sapiens
MKPQTLAAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSRSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFKSSKFTRTISPPTLGTLRSCFSWSGGLGDFSRTPSPSPSTALQQFRRKSDSPTSLPENNMSDVSQLKSEESSDDESHPLREGACSSQSQESGEFSLQSSNASKLSQCSSKDSDSEESDCNIKLLDSQSDQTSKLCLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 754633 - protein, 846 aa, Homo sapiens [sequence omitted]

SEQ ID NO: 754634 - protein, 853 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSRSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFKSSKFTRTISPPTLGTLRSCFSWSGGLGDFSRTPSPSPSTALQQFRRKSDSPTSLPENNMSDVSQLKSEESSDDESHPLREGACSSQSQESGEFSLQSSNASKLSQCSSKDSDSEESDCNIKLLDSQSDQTSKLCLSHFSKKDTPLRNKVPGLYKSSSADSLSTTKIKPLGPARASGLSKKPASIQKRKHHNAENKPGLQIKLNELWKNFGFKNKWCLESDDFSTEHHSAFRVQAIHHMPSQGAEFTASYMIGRNLYHIICFLTG

SEQ ID NO: 754635 - protein, 139 aa, Homo sapiens
MGIQGLLQFIKEASEPIHVRKYKGQVVAVDTYCWLHKGAIACAEKLAKGEPTDRRRQANLLKGKQLLREGKVSEARECFTRSINITHAMAHKVIKGQARRKRCDAGQSVKYKEMCALCSQEKRGCIVCGSREETLIGHK

SEQ ID NO: 754636 - protein, 846 aa, Homo sapiens [sequence omitted]

SEQ ID NO: 754637 - protein, 846 aa, Homo sapiens [sequence omitted]

SEQ ID NO: 754638 - protein, 876 aa, Homo sapiens
MGIQGLLQFIKEASEPIHVRKYKGQVVAVDTYCWLHKGAIACAEKLAKGEPTDRRRQANLLKGKQLLREGKVSEARECFTRSINITHAMAHKVIKGQARRKRCDAGQSVKYKEMCALCSQEKRGCIVCGSREETLIGHKKWCKSVSRIGGFLASLTSRMKPQTLAAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSRSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFKSSKFTRTISPPTLGTLRSCFSWSGGLGDFSRTPSPSPSTALQQFRRKSDSPTSLPENNMSDVSQLKSEESSDDESHPLREGACSSQSQESGEFSLQSSNASKLSQCSSKDSDSEESDCNIKLLDSQSDQTSKLCLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 754639 - protein, 846 aa, Homo sapiens [sequence omitted]

SEQ ID NO: 754640 - protein, 838 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSRSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFKSSKFTRTISPPTLGTLRSCFSWSGGLGDFSRTPSPSPSTALQQFRRKSDSPTSLPENNMSDVSQLKSEESSDDESHPLREGACSSQSQESGEFSLQSSNASKLSQCSSKDSDSEESDCNIKLLDSQSDQTSKLCLSHFSKKDTPLRNKVPGLYKSSSADSLSTTKIKPLGPARASGLSKKPASIQKRKHHNAENKPGLQIKLNELWKNFGFKKWSLAVSQSQLTATSASQVQAILPQPPKELRLQLPPS

SEQ ID NO: 754641 - protein, 123 aa, Homo sapiens
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQASLPVHNQVLPSIESVDGSDPLATL

SEQ ID NO: 754642 - protein, 72 aa, Homo sapiens
LKNQLVELPPYTQLAVSLSHHWKTDIPCPLGLDGLCSSSFTNAPTTFLGVSEAQCGLQFSRLAGTSLISQGC

SEQ ID NO: 754643 - protein, 368 aa, Homo sapiens
SSRPAAAGTGSGLRRDWERAPQRTLARGSAQSVCEDPARRPPGDPMASEGLAGALASVLAGQGSSVHSCDSAPAGEPPAPVRLRKNVCYVVLAVFLSEQDEVLLIQEAKRECRGSWYLPAGRMEPGETIVEALQREVKEEAGLHCEPETLLSVEERGPSWVRFVFLARPTGGILKTSKEADAESLQAAWYPRTSLPTPLRAHDILHLVELAAQYRQQARHPLILPQELPCDLVCQRLVATFTSAQTVWVLVGTVGMPHLPVTACGLDPVEQRGGMKMAVLRLLQECLTLHHLVVEIKGLLGLQHLGRDHSDGICLNVLVTVAFRSPGIQDEPPKVRGENFSWWKVMEEDLQSQLLQRLQGSSVVPVNR

SEQ ID NO: 754644 - protein, 447 aa, Homo sapiens
SSRPAAAGTGSGLRRDWERAPQRTLARGSAQSVCEDPARRPPGDPMASEGLAGALASVLAGQGSSVHSCDSAPAGEPPAPVRLRKNVCYVVLAVFLSEQDEVLLIQEAKRECRGSWYLPAGRMEPGETIVEALQREVKEEAGLHCEPETLLSVEERGPSWVRFVFLARPTGMAHLEECEQGQLTPFPQLLGEVEPLYSQSCYGWHSLAWADSSLWAGGLSPGSGMSVDSARAALLSTQTLPAPSPTSPPGGILKTSKEADAESLQAAWYPRTSLPTPLRAHDILHLVELAAQYRQQARHPLILPQELPCDLVCQRLVATFTSAQTVWVLVGTVGMPHLPVTACGLDPVEQRGGMKMAVLRLLQECLTLHHLVVEIKGLLGLQHLGRDHSDGICLNVLVTVAFRSPGIQDEPPKVRGENFSWWKVMEEDLQSQLLQRLQGSSVVPVNR

SEQ ID NO: 754645 - protein, 368 aa, Homo sapiens; identical to SEQ ID NO: 754643

SEQ ID NO: 754646 - protein, 347 aa, Homo sapiens
LDEKPVIIASCLHKEYAGQKKSCFSKRKKKIAARNISFCVQEGEILGLLGPNGAGKSSSIRMISGITKPTAGEVELKGCSSVLGHLGYCPQENVLWPMLTLREHLEVYAAVKGLRKADARLAIARLVSAFKLHEQLNVPVQKLTAGITRKLCFVLSLLGNSPVLLLDEPSTGIDPTGQQQMWQAIQAVVKNTERGVLLTTHNLAEAEALCDRVAIMVSGRLRCIGSIQHLKNKLGKDYILELKVKETSQVTLVHTEILKLFPQAAGQERYSSLLTYKLPVADVYPLSQTFHKLEAVKHNFNLEEYSLSQCTLEKVFLELSKEQEVGNFDEEIDTTMRWKLLPHSDEP

SEQ ID NO: 754647 - protein, 329 aa, Homo sapiens
LDEKPVIIASCLHKEYAGQKKSCFSKRKKKIAARNISFCVQEGEILGLLGPNGAGKSSSIRMISGITKPTAGEVELKGCSSVLGHLGYCPQENVLWPMLTLREHLEVYAAVKGLRKADARLAIARLVSAFKLHEQLNVPVQKLTAGITRKLCFVLSLLGNSPVLLLDEPSTGIDPTGQQQMWQAIQAVVKNTERGVLLTTHNLAEAEALCDRVAIMVSGRLRCIGSIQHLKNKLGKDYILELKVKETSQVTLVHTEILKLFPQAAGQERYSSLLTYKLPVADVYPLSQTFHKLEAVKHNFNLEEYSLSQCTLEKVFLELSKEQEVGNFE

SEQ ID NO: 754648 - protein, 309 aa, Homo sapiens
LDEKPVIIASCLHKEYAGQKKSCFSKRKKKIAARNISFCVQEGEILGLLGPNGAGKSSSIRMISGITKPTAGEVELKGCSSVLGHLGYCPQENVLWPMLTLREHLEVYAAVKGLRKADARLAIARLVSAFKLHEQLNVPVQKLTAGITRKLCFVLSLLGNSPVLLLDEPSTGIDPTGQQQMWQAIQAVVKNTERGVLLTTHNLAEAEALCDRVAIMVSGRLRCIGSIQHLKNKLGKDYILELKVKETSQVTLVHTEILKLFPQAAGQERYSSLLTYKLPVADVYPLSQTFHKLEAEDYVKKLLAGRMGK

SEQ ID NO: 754649 - protein, 215 aa, Homo sapiens
ITLVSRFLSMLEEEVYSQNSPIWDQDFLSASSRTSQLGIQTVINPPPVAGTISYNSTSSSLEQPNAGSSSPACKASSGLEANPGEKRKMTDSHVLEEAKKPRVMGDIPMELINEVMSTITDPAAMLGPETNFLSAHSARDEAARLEERRGVIEFHVVGNSLNQKPNKKILMWLVGLQNVFSHQLPRMPKEYITRLVFDPKHKTLACSAGGSLEST

SEQ ID NO: 754650 - protein, 832 aa, Homo sapiens
MSEAGGAGPGGCGAGAGAGAGPGALPPQPAALPPAPPQGSPCAAAAGGSGACGPATAVAAAGTAEGPGGGGSARIAVKKAQLRSAPRAKKLEKLGVYSACKAEESCKCNGWKNPNPSPTPPRADLQQIIVSLTESCRSCSHALAAHVSHLENVSEEEMNRLLGIVLDVEYLFTCVHKEEDADTKQVYFYLFKLLRKSILQRGKPVVEGSLEKKPPFEKPSIEQGVNNFVQYKFSHLPAKERQTIVELAKMFLNRINYWHLEAPSQRRLRSPNDDISGYKENYTRWLCYCNVPQFCDSLPRYETTQVFGRTLLRSVFTVMRRQLLEQARQEKDKLPLEKRTLILTHFPKFLSMLEEEVYSQNSPIWDQDFLSASSRTSQLGIQTVINPPPVAGTISYNSTSSSLEQPNAGSSSPACKASSGLEANPGEKRKMTDSHVLEEAKKPRVMGDIPMELINEVMSTITDPAAMLGPETNFLSAHSARDEAARLEERRGVIEFHVVGNSLNQKPNKKILMWLVGLQNVFSHQLPRMPKEYITRLVFDPKHKTLALIKDGRVIGGICFRMFPSQGFTEIVFCAVTSNEQVKGYGTHLMNHLKEYHIKHDILNFLTYADEYAIGYFKKQGFSKEIKIPKTKYVGYIKDYEGATLMGCELNPRIPYTEFSVIIKKQKEIIKKLIERKQAQIRKVYPGLSCFKDGVRQIPIESIPGIRETGWKPSGKEKSKEPRDPDQLYSTLKSILQQVKSHQSAWPFMEPVKRTEAPGYYEVIRFPMDLKTMSERLKNRYYVSKKLFMADLQRVFTNCKEYNPPESEYYKCANILEKFFFSKIKEAGLIDK

SEQ ID NO: 754651 - protein, 832 aa, Homo sapiens; identical to SEQ ID NO: 754650

SEQ ID NO: 754652 - protein, 775 aa, Homo sapiens
MSEAGGAGPGGCGAGAGAGAGPGALPPQPAALPPAPPQGSPCAAAAGGSGACGPATAVAAAGTAEGPGGGGSARIAVKKAQLRSAPRAKKLEKLGVYSACKAEESCKCNGWKNPNPSPTPPRADLQQIIVSLTESCRSCSHALAAHVSHLENVSEEEMNRLLGIVLDVEYLFTCVHKEEDADTKQVYFYLFKLLRKSILQRGKPVVEGSLEKKPPFEKPSIEQGVNNFVQYKFSHLPAKERQTIVELAKMFLNRINYWHLEAPSQRRLRSPNDDISGYKENYTRWLCYCNVPQFCDSLPRYETTQVFGRTLLRSVFTVMRRQLLEQARQEKDKLPLEKRTLILTHFPKFLSMLEEEVYSQNSPIWDQDFLSASSRTSQLGIQTVINPPPVAGTISYNSTSSSLEQPNAGSSSPACKASSGLEANPGEKRKMTDSHVLEEAKKPRVMGDIPMELINEVMSTITDPAAMLGPETNFLSAHSARDEAARLEERRGVIEFHVVGNSLNQKPNKKILMWLVGLQNVFSHQLPRMPKEYITRLVFDPKHKTLALIKDGRVIGGICFRMFPSQGFTEIVFCAVTSNEQVKGYGTHLMNHLKEYHIKHDILNFLTYADEYAIGYFKKQGFSKEIKIPKTKYVGYIKDYEGATLMGCELNPRIPYTEFSVIIKKQKEIIKKLIERKQAQIRKVYPGLSCFKDGVRQIPIESIPGIRETGWKPSGKEKSKEPRDPDQLYSTLKSILQQVKSHQSAWPFMEPVKRTEAPGYYEVIRFPMGNTINIF

SEQ ID NO: 754653 - protein, 807 aa, Homo sapiens
MSEAGGAGPGGCGAGAGAGAGPGALPPQPAALPPAPPQGSPCAAAAGGSGACGPATAVAAAGTAEGPGGGGSARIAVKKAQLRSAPRAKKLEKLGVYSACKAEESCKCNGWKNPNPSPTPPRADLQQIIVSLTESCRSCSHALAAHVSHLENVSEEEMNRLLGIVLDVEYLFTCVHKEEDADTKQVYFYLFKLLRKSILQRGKPVVEGSLEKKPPFEKPSIEQGVNNFVQYKFSHLPAKERQTIVELAKMFLNRINYWHLEAPSQRRLRSPNDDISGYKENYTRWLCYCNVPQFCDSLPRYETTQVFGRTLLRSVFTVMRRQLLEQARQEKDKLPLEKRTLILTHFPKFLSMLEEEVYSQNSPIWDQDFLSASSRTSQLGIQTVINPPPVAGTISYNSTSSSLEQPNAGSSSPACKASSGLEANPGEKRKMTDSHVLEEAKKPRVMGDIPMELINEVMSTITDPAAMLGPETNFLSAHSARDEAARLEERRGVIEFHVVGNSLNQKPNKKILMWLVGLQNVFSHQLPRMPKEYITRLVFDPKHKTLALIKDGRVIGGICFRMFPSQGFTEIVFCAVTSNEQVKGYGTHLMNHLKEYHIKHDILNFLTYADEYAIGYFKKQGFSKEIKIPKTKYVGYIKDYEGATLMGCELNPRIPYTEFSVIIKKQKEIIKKLIERKQAQIRKVYPGLSCFKDGVRQIPIESIPGIRETGWKPSGKEKSKEPRDPDQLYSTLKSILQQVKSHQSAWPFMEPVKRTEAPGYYEVIRFPMDLKTMSERLKNRYYVSKKLFMADLQRVFTNCKEYNPPEK

SEQ ID NO: 754654 - protein, 832 aa, Homo sapiens; identical to SEQ ID NO: 754650

SEQ ID NO: 754655 - protein, 388 aa, Homo sapiens
MRSLDVSHPHCLERIALCNFFLSLASQTNFLSAHSARDEAARLEERRGVIEFHVVGNSLNQKPNKKILMWLVGLQNVFSHQLPRMPKEYITRLVFDPKHKTLALIKDGRVIGGICFRMFPSQGFTEIVFCAVTSNEQVKGYGTHLMNHLKEYHIKHDILNFLTYADEYAIGYFKKQGFSKEIKIPKTKYVGYIKDYEGATLMGCELNPRIPYTEFSVIIKKQKEIIKKLIERKQAQIRKVYPGLSCFKDGVRQIPIESIPGIRETGWKPSGKEKSKEPRDPDQLYSTLKSILQQVKSHQSAWPFMEPVKRTEAPGYYEVIRFPMDLKTMSERLKNRYYVSKKLFMADLQRVFTNCKEYNPPESEYYKCANILEKFFFSKIKEAGLIDK

SEQ ID NO: 754656 - protein, 498 aa, Homo sapiens
MSEAGGAGPGGCGAGAGAGAGPGALPPQPAALPPAPPQGSPCAAAAGGSGACGPATAVAAAGTAEGPGGGGSARIAVKKAQLRSAPRAKKLEKLGVYSACKAEESCKCNGWKNPNPSPTPPRADLQQIIVSLTESCRSCSHALAAHVSHLENVSEEEMNRLLGIVLDVEYLFTCVHKEEDADTKQVYFYLFKLLRKSILQRGKPVVEGSLEKKPPFEKPSIEQGVNNFVQYKFSHLPAKERQTIVELAKMFLNRINYWHLEAPSQRRLRSPNDDISGYKENYTRWLCYCNVPQFCDSLPRYETTQVFGRTLLRSVFTVMRRQLLEQARQEKDKLPLEKRTLILTHFPKFLSMLEEEVYSQNSPIWDQDFLSASSRTSQLGIQTVINPPPVAGTISYNSTSSSLEQPNAGSSSPACKASSGLEANPGEKRKMTDSHVLEEAKKPRVMGDIPMELINEVMSTITDPAAMLGPEVSRVNLGSQLVDLFCSPGHSSCQKWGC

SEQ ID NO: 754657 - protein, 87 aa, Homo sapiens
MGAAAATKTTPAALAGPEGGRLRTSAGRSLRWEALAGAPPVLRCEPGHKEPSALAPQDRGPELEASVHPCGSRHVHVATMTPSASQG

SEQ ID NO: 754658 - protein, 87 aa, Homo sapiens; identical to SEQ ID NO: 754657

SEQ ID NO: 754659 - protein, 243 aa, Homo sapiens [sequence omitted]

SEQ ID NO: 754660 - protein, 238 aa, Homo sapiens
MEVPTAYMISPKEREKASNLKLSSRPPATSHLIRTPKDTHYCGASKGLGNSFIGNESFLPEFINGDFDSIRPEVREYYATKGCELISTPDQDHTDFTKCLKMLQKKIEEKDLKVDVIVTLGGLAGRFDQIMASVNTLFQATHITPFPIIIIQEESLIYLLQPGKHRLHVDTGMEGDWCGLIPVGQPCMQVTTTGLKWNLTNDVLAFGTLVSTSNTYDGSGVVTVETDHPLLWTMAIKS

SEQ ID NO: 754661 - protein, 137 aa, Homo sapiens
MLQKKIEEKDLKVDVIVTLGGLAGRFDQIMASVNTLFQATHITPFPIIIIQEESLIYLLQPGKHRLHVDTGMEGDWCGLIPVGQPCMQVTTTGLKWNLTNDVLAFGTLVSTSNTYDGSGVVTVETDHPLLWTMAIKS

SEQ ID NO: 754662 - protein, 204 aa, Homo sapiens
ERRAVDRRSSRSLRSPVCGSYQPLWNLKYCLVILNQPLDNYFRHLWNKALLRACADGGANRLYDITEGERESFLPEFINGDFDSIRPEVREYYATKGCELISTPDQDHTDFTKCLKMLQKKIEEKDLKGKHRLHVDTGMEGDWCGLIPVGQPCMQVTTTGLKWNLTNDVLAFGTLVSTSNTYDGSGVVTVETDHPLLWTMAIKS

SEQ ID NO: 754663 - protein, 243 aa, Homo sapiens [sequence omitted]

SEQ ID NO: 754664 - protein, 137 aa, Homo sapiens; identical to SEQ ID NO: 754661

SEQ ID NO: 754665 - protein, 1937 aa, Homo sapiens
HEAARGMTCALNNLLHSLQLPESCSEIKHEAFKNHVFNVDNAKFVVKFDLSALTTIGNAKNSLIGMWALSPTVFALLSKNLMIVHSDLAVHFPAIQYAVLYTLYPHCTRHDHFIFSSLSSSSPSLFDGAVIGTVTMATKKHFSIILNLLGMLLKKDNQDTRKLLMTWALEVAVVMKKSETYAPLFCLPSFHKFCKGLLADTLVEDVNICLQACSSLHALSSSLPDDLLQRCVDVCRVQLVHRGTCIRQAFGKLLKSIPLGVFLSDNNHTEIQEISLALRSHMSKAPSNTFHPQDFSDVISFILYGNSHRTGKDNWLERLFYSCQRLDKRDQSTIPRNLLKTDAILWQWAIWEAAQFTVLYKLRTPLGRAQDTFQTIEGIIRSLAGHTLNPDQDVSQWTTADSDEGHGNNQLRLVLLLQYLENLEKLMYNAYEGCANALTSPPKVIRTFLYTNRQTCQDWLTRIRLSIMRVGLLAGQPAVTVRHGFDLLTEMKTTSLSQGNELEVSIMMVVEALCELHCPEAIQGIAVWSSSIVGKHLLWINSVAQQAEGRFEKASVEYQEHLCAMTGVDCCISSFDKSVLTLASAGCKSASLKHCLNGESRKSVLSKPTDSSPEVINYLGNKACECYISTADWAAVQEWQNAIHDLKKSTSSTSLNLKADFNYIKSLSSFESGKFVECTEQLELLPGENINLLAGGSKEKIDMKKLLRNMRSPDPREPQKSIEVPLLRSSVCLATALNPIEQDQKWQSITENVVKYLKQTSRIAIGPLRLSTLTVSQSLPVLSTLQLYCSSALETTVSNRLSTEDCLIPLFGEALRSCKQHDVRPWMQALRYTVYQNQLLEKIKGMICEILRETEVTNETIVPVSHRRKLRLALIMAPVLILQMVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPLLQERLFATGSEWRQRSIVILQDVPYWPYLTAETLKNRMGHQPPPPTQQHSITDNSLSLKTPPECLLTPLPPSADDNLKTPPECVLTPLPPSADDNLKTPPECVLIPFHPQRMIISRHLLSVSSLPFHPQRMIISRHLPSVCSLPFHPQLYPQLHPQQMIISRHVPSVCSIPFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMINIKTPAFHPQRMIISRHLPSVSSLPFHPQLHPQQMIISRYLLSVCGFRFHHQPMIISRHLPSVSSLPFHPQLHPQQMIISRHLPSVCGGRFHPQRMIISRHLPSISSLPFHPQLHPQQMIISRHLPSVCGGRFHPQRMIISRHLPSVSSLPFHPQLHPQQMIISRHLPSVCGGRFHPQRMIISRHLPSVSSLPFHTQLHPQQMIISRHLPSVCGELCGGRFHPQRMIISRHLPSVSSLPFHPQLHPQQMIISRHLLSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQPDDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 754666 - protein, 1808 aa, Homo sapiens
MAIRLTLIAKKHFSIILNLLGMLLKKDNQDTRKLLMTWALEVAVVMKKSETYAPLFCLPSFHKFCKGLLADTLVEDVNICLQACSSLHALSSSLPDDLLQRCVDVCRVQLVHRGTCIRQAFGKLLKSIPLGVFLSDNNHTEIQEISLALRSHMSKAPSNTFHPQDFSDVISFILYGNSHRTGKDNWLERLFYSCQRLDKRDQSTIPRNLLKTDAILWQWAIWEAAQFTVLYKLRTPLGRAQDTFQTIEGIIRSLAGHTLNPDQDVSQWTTADSDEGHGNNQLRLVLLLQYLENLEKLMYNAYEGCANALTSPPKVIRTFLYTNRQTCQDWLTRIRLSIMRVGLLAGQPAVTVRHGFDLLTEMKTTSLSQGNELEVSIMMVVEALCELHCPEAIQGIAVWSSSIVGKHLLWINSVAQQAEGRFEKASVEYQEHLCAMTGVDCCISSFDKSVLTLASAGCKSASLKHCLNGESRKSVLSKPTDSSPEVINYLGNKACECYISTADWAAVQEWQNAIHDLKKSTSSTSLNLKADFNYIKSLSSFESGKFVECTEQLELLPGENINLLAGGSKEKIDMKKLLRNMRSPDPREPQKSIEVPLLRSSVCLATALNPIEQDQKWQSITENVVKYLKQTSRIAIGPLRLSTLTVSQSLPVLSTLQLYCSSALETTVSNRLSTEDCLIPLFGEALRSCKQHDVRPWMQALRYTVYQNQLLEKIKGMICEILRETEVTNETIVPVSHRRKLRLALIMSPFLILQMVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPLLQERLFATGSEWRQRSIVILQDVPYWPYLTAETLKNRMGHQPPPPTQQHSITDNSLSLKTPPECLLTPLPPSADDNLKTPPECVLTPLPPSADDNLKTPPECVLIPFHPQRMIISRHLLSVSSLPFHPQRMIISRHLPSVCSLPFHPQLYPQLHPQQMIISRHVPSVCSIPFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMINIKTPAFHPQRMIISRHLPSVSSLPFHPQLHPQQMIISRYLLSVCGFRFHHQPMIISRHLPSVSSLPFHPQLHPQQMIISRHLPSVCGGRFHPQRMIISRHLPSISSLPFHPQLHPQQMIISRHLPSVCGGRFHPQRMIISRHLPSVSSLPFHPQLHPQQMIISRHLPSVCGGRFHPQRMIISRHLPSVSSLPFHTQLHPQQMIISRHLPSVCGERCGGRFHPQRMIISRHLPSVSSLPFHPQLHPQQMIISRHLLSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQPDDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 754667 - protein, 581 aa, Homo sapiens
MAIRLTLIAKKHFSIILNLLGMLLKKDNQDTRKLLMTWALEVAVVMKKSETYAPLFCLPSFHKFCKGLLADTLVEDVNICLQACSSLHALSSSLPDDLLQRCVDVCRVQLVHRGTCIRQAFGKLLKSIPLGVFLSDNNHTEIQEISLALRSHMSKAPSNTFHPQDFSDVISFILYGNSHRTGKDNWLERLFYSCQRLDKRDQSTIPRNLLKTDAILWQWAIWEAAQFTVLYKLRTPLGRAQDTFQTIEGIIRSLAGHTLNPDQDVSQWTTADSDEGHGNNQLRLVLLLQYLENLEKLMYNAYEGCANALTSPPKVIRTFLYTNRQTCQDWLTRIRLSIMRVGLLAGQPAVTVRHGFDLLTEMKTTSLSQGNELEVSIMMVVEALCELHCPEAIQGIAVWSSSIVGKHLLWINSVAQQAEGRFEKASVEYQEHLCAMTGVDCCISSFDKSVLTLASAGCKSASLKHCLNGESRKSVLSKPTDSSPEVINYLGNKACECYISTADWAAVQEWQNAIHDLKKSTSSTSLNLKADFNYIKSLSSFESGKFVECTEQLELLPGENINLLAGGSKEKIDMKKLLRNM

SEQ ID NO: 754668 - protein, 285 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGY

SEQ ID NO: 754669 - protein, 285 aa, Homo sapiens; identical to SEQ ID NO: 754668

SEQ ID NO: 754670 - protein, 285 aa, Homo sapiens; identical to SEQ ID NO: 754668

SEQ ID NO: 754671 - protein, 320 aa, Homo sapiens
LGTSPWVNRPRGVFWACGVSWTGAAGLQDGALSDTMARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGY

SEQ ID NO: 754672 - protein, 285 aa, Homo sapiens; identical to SEQ ID NO: 754668

SEQ ID NO: 754673 - protein, 210 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKLGRGRQPGERRGRQPAEVHCSRPCSLAARD

SEQ ID NO: 754674 - protein, 210 aa, Homo sapiens; identical to SEQ ID NO: 754673

SEQ ID NO: 754675 - protein, 169 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKELGRGRQPGERRGRQPAEVHCSRPCSLAARD

SEQ ID NO: 754676 - protein, 135 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNPMSTKNTKKLAGRTGMHL

SEQ ID NO: 754677 - protein, 433 aa, Homo sapiens
MAGPGPGPGDPDEQYDFLFKLVLVGDASVGKTCVVQRFKTGAFSERQGSTIGVDFTMKTLEIQDKRVKLQIWDTAGQERFRTITQSYYRSANGAILAYDITKRSSFLSVPHWIEDVRKYAGSNIVQLLIGNKSDLSELREVSLAEAQSLAEHYDILCAIETSAKDSSNVEEAFLRVATELIMRHGGPLFSEKSPDHIQLNSKDIGEGWGCGCCPGAGPADWGFPTSLLSPACQAQPSRASPPGYRQLQQPGEALELCILWPGCGMEALLEEGEAGYPGGPPCQPAAGPPPSSHSKTGLNPPVWATVGGASSPPCPMPAGSDRFLSWVCFTCGSRLLLSRDVSSALGSSRSSWGSAQSSRARAMRPTDLVPERSSREAPAPSRRGTCFLPSLPLQHSQTSPWGLAHCLIRTSEFSDFLCSFSFSSAQHGVTAHS

SEQ ID NO: 754678 - protein, 285 aa, Homo sapiens; identical to SEQ ID NO: 754668

SEQ ID NO: 754679 - protein, 649 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGLQIWDTAGQERFRTITQSYYRSANGAILAYDITKRSSFLSVPHWIEDVRKYAGSNIVQLLIGNKSDLSELREVSLAEAQSLAEHYDILCAIETSAKDSSNVEEAFLRVATELIMRHGGPLFSEKSPDHIQLNSKDIGEGWGCGCCPGAGPADWGFPTSLLSPACQAQPSRASPPGYRQLQQPGEALELCILWPGCGMEALLEEGEAGYPGGPPCQPAAGPPPSSHSKTGLNPPVWATVGGASSPPCPMPAGSDRFLSWVCFTCGSRLLLSRDVSSALGSSRSSWGSAQSSRARAMRPTDLVPERSSREAPAPSRRGTCFLPSLPLQHSQTSPWGLAHCLIRTSEFSDFLCSFSFSSAQHGVTAHS

SEQ ID NO: 754680 - protein, 285 aa, Homo sapiens; identical to SEQ ID NO: 754668

SEQ ID NO: 754681 - protein, 285 aa, Homo sapiens; identical to SEQ ID NO: 754668

SEQ ID NO: 754682 - protein, 649 aa, Homo sapiens; identical to SEQ ID NO: 754679

SEQ ID NO: 754683 - protein, 307 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKERQVRWLMPVIPALWEAEAGGSQALPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGY

SEQ ID NO: 754684 - protein, 326 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGYMSCQSEPLPDLFSSCVVEILFFLLRQLKSSSLIHLEKWSQKVGPKMLDHEGKEVPGNRGYKYFGAAKDLPGVRELFEKEPLPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGY

SEQ ID NO: 754685 - protein, 105 aa, Homo sapiens
MEKLALKCWIMKEKKSQETEVTSTLEQQKICLVLESCLKKNSDEEGSQEKGGDDSQQKFIAHVPVPSQQEIEEALVRRKKMELLQKYASETLQAQSEEARRLLGY

SEQ ID NO: 754686 - protein, 74 aa, Homo sapiens
LGYVWGNYMSVSLGFSTRAGQILRKNPLVSFLQVGGLAACGLEAKWENKAVGGSSITEFIRCVFKEGDSTSSKV

SEQ ID NO: 754687 - protein, 103 aa, Homo sapiens
PALTLLFYYYISQHLVVPNMRMWLARGKQQNTKPDLSQIGKTRGESAKLSPFGMPIPSRKQLGQCSSALHKQTTVGSLIPGLACEGLPQVSPFTVVHIYSDFC

SEQ ID NO: 754688 - protein, 269 aa, Homo sapiens
MTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIYFFMCRSFSRRLFKKSNIRTRSESIRSLQSVRRSEVRIYYDYTDV

SEQ ID NO: 754689 - protein, 358 aa, Homo sapiens
MGFNLTLAKLPNNELHGQESHNSGNRSDGPGKNTTLHNEFDTIVLPVLYLIIFVASILLNGLAVWIFFHIRNKTSFIFYLKNIVVADLIMTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIYFFMCRSFSRRLFKKSNIRTRSESIRSLQSVRRSEVRIYYDYTDV

SEQ ID NO: 754690 - protein, 623 aa, Homo sapiens
MSCRQFSSSYLSRSGGGGGGGLGSGGSIRSSYSRFSSSGGRGGGGRFSSSSGYGGGSSRVCGRGGGGSFGYSYGGGSGGGFSASSLGGGFGGGSRGFGGASGGGYSSSGGFGGGFGGGSGGGFGGGYGSGFGGLGGFGGGAGGGDGGILTANEKSTMQELNSRLASYLDKVQALEEANNDLENKIQDWYDKKGPAAIQKNYSPYYNTIDDLKDQIVDLTVGNNKTLLDIDNTRMTLDDFRIKFEMEQNLRQGVDADINGLRQVLDNLTMEKSDLEMQYETLQEELMALKKNHKEEMSQLTGQNSGDVNVEINVAPGKDLTKTLNDMRQEYEQLIAKNRKDIENQYETQITQIEHEVSSSGQEVQSSAKEVTQLRHGVQELEIELQSQLSKKAALEKSLEDTKNRYCGQLQMIQEQISNLEAQITDVRQEIECQNQEYSLLLSIKMRLEKEIETYHNLLEGGQEDFESSGAGKIGLGGRGGSGGSYGRGSRGGSGGSYGGGGSGGGYGGGSGSRGGSGGSYGGGSGSGGGSGGGYGGGSGGGHSGGSGGGHSGGSGGNYGGGSGSGGGSGGGYGGGSGSRGGSGGSHGGGSGFGGESGGSYGGGEEASGSGGGYGGGSGKSSHS

SEQ ID NO: 754691 - protein, 522 aa, Homo sapiens
PRGRGQRQSRYLSRPPRPAASEEARAKRAGGDQVRAGGSRARPRPRTLRPELHGTMAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPPAMITLNNSVYWQEFEDTCVYECLDGKDCQSFFCCYEECKSGSWRKGRIHIDILELDSYSRVFFPTSFLLFNLVYWVGYLYL

SEQ ID NO: 754692 - protein, 348 aa, Homo sapiens
PRSWGEGYRRGWLLGMQPRVSQSQTWQENKLSEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSKPSCCPACGLQGLPFRSLVSHPRISRAFCLPV

SEQ ID NO: 754693 - protein, 461 aa, Homo sapiens
PRGRGQRQSRYLSRPPRPAASEEARAKRAGGDQVRAGGSRARPRPRTLRPELHGTMAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSKPSCCPACGLQGLPFRSLVSHPRISRAFCLPV

SEQ ID NO: 754694 - protein, 231 aa, Homo sapiens
MVGNEAKKVKSWARWLTPVITALLEAEAGRLLEPRSSRSAWVTRDLVSMQNQKSKLGVVTGGANLGRIGVISNRERHPGSFDVVHVKKMPMATALPLRLSNISDIGKGKRTMDVSSPRKRVSASPLPEERDHQTGGQTRARGVTTGPRVTTADSSTQLTHTGPRIPRNKTQHTTPHRQQHPQEGPPAHGTQRHGSNGPPLHNPHKNTRPAPTNREHNGANSTRHARTSTPI

SEQ ID NO: 754695 - protein, 329 aa, Homo sapiens
SPASCGFGDHRAAAMGARLGRRAGPEAGSEAGAAAGCGPAPYERRVRWLREIQSTLRERRPERARQLLRLLRQDLGLERTLLPDILYRDVAFLNPVDPISHDLLVNLARDLQCPKKDYELWKSSDKICRQLIYHLTPHSKQQQGSSLRQRKTQSCLKSSLQKTLLAGETVDLSGIPLSTQDVQHITRYLSSHGAVLAVLDLSFTGLSDELLHLLLPSLWALPRLTQLLLNGNRLTRATARKLTDAIKDTTKFPALAWVDLGNNVDVASLPQPLLVGLRRRLSQRTSLPTIYEGLDLEPEGSAAGATTPASTWDSTAAGLGPEPQACCAR

SEQ ID NO: 754696 - protein, 221 aa, Homo sapiens
MVTLPSQQDYELWKSSDKICRQLIYHLTPHSKQQQGSSLRQRKTQSCLKSSLQKTLLAGETVDLSGIPLSTQDVQHITRYLSSHGAVLAVLDLSFTGLSDELLHLLLPSLWALPRLTQLLLNGNRLTRATARKLTDAIKDTTKFPALAWVDLGNNVDVASLPQPLLVGLRRRLSQRTSLPTIYEGLDLEPEGSAAGATTPASTWDSTAAGLGPEPQACCAR

SEQ ID NO: 754697 - protein, 68 aa, Homo sapiens
MVTLPSHRTMSSGSPRTRSADSSSTTSPLTRSSSKGPACARGRPRAGKGSPATAPPHCCSKVPSQVDT

SEQ ID NO: 754698 - protein, 268 aa, Homo sapiens
MPPALSAQTQTPQAQSRLESERKKNTLTWLVPTPWDWRQWSTAPSRGLVWPPPPVDYELWKSSDKICRQLIYHLTPHSKQQQGSSLRQRKTQSCLKSSLQKTLLAGETVDLSGIPLSTQDVQHITRYLSSHGAVLAVLDLSFTGLSDELLHLLLPSLWALPRLTQLLLNGNRLTRATARKLTDAIKDTTKFPALAWVDLGNNVDVASLPQPLLVGLRRRLSQRTSLPTIYEGLDLEPEGSAAGATTPASTWDSTAAGLGPEPQACCAR

SEQ ID NO: 754699 - protein, 268 aa, Homo sapiens; identical to SEQ ID NO: 754698

SEQ ID NO: 754700 - protein, 107 aa, Homo sapiens [sequence omitted]

SEQ ID NO: 754701 - protein, 137 aa, Homo sapiens
ISVQLPLRRRLQCTKMAAPVDLELKKAFTELQAKVIDTQQKVKLADIQIEQLNRTKKHAHLTDTEIMTLVDETNMYEGVGRMFILQSKEAIHSQLLEKQKIAEEKIKELEQKKSYLERSVKEAEDNIREMLMARRAQ

SEQ ID NO: 754702 - protein, 122 aa, Homo sapiens
MAAPVDLELKKAFTELQAKVIDTQQKVKLADIQIEQLNRTKKHAHLTDTEIMTLVDETNMYEGVGRMFILQSKEAIHSQLLEKQKIAEEKIKELEQKKSYLERSVKEAEDNIREMLMARRAQ

SEQ ID NO: 754703 - protein, 137 aa, Homo sapiens; identical to SEQ ID NO: 754701

SEQ ID NO: 754704 - protein, 137 aa, Homo sapiens; identical to SEQ ID NO: 754701

SEQ ID NO: 754705 - protein, 137 aa, Homo sapiens; identical to SEQ ID NO: 754701

SEQ ID NO: 754706 - protein, 137 aa, Homo sapiens; identical to SEQ ID NO: 754701

SEQ ID NO: 754707 - protein, 137 aa, Homo sapiens; identical to SEQ ID NO: 754701

SEQ ID NO: 754708 - protein, 70 aa, Homo sapiens
QAGKARRYRDETRFRFILQSKEAIHSQLLEKQKIAEEKIKELEQKKSYLERSVKEAEDNIREMLMARRAQ

SEQ ID NO: 754709 - protein, 73 aa, Homo sapiens
CIDYLRKNLQETTGEELRFILQSKEAIHSQLLEKQKIAEEKIKELEQKKSYLERSVKEAEDNIREMLMARRAQ

SEQ ID NO: 754710 - protein, 137 aa, Homo sapiens; identical to SEQ ID NO: 754701

SEQ ID NO: 754711 - protein, 144 aa, Homo sapiens
RRRLREWSESGAYPCELQGHYCAHCIMNAQKLIDLYSRTRMLADIQIEQLNRTKKHAHLTDTEIMTLVDETNMYEGVGRISFFELRRQANSPGRACSAAQPANISQQAKHIKDTENSQKKSYLERSVKEAEDNIREMLMARRAQ

SEQ ID NO: 754712 - protein, 113 aa, Homo sapiens
ISVQLPLRRRLQCTKMAAPVDLELKKAFTELQAKVIDTQQKVKLADIQIEQLNRTKKHAHLTDTEIMTLVDETNMYEGVGRMFILQSKEAIHSQLLEKQKIAEEKIKELEGRC

SEQ ID NO: 754713 - protein, 137 aa, Homo sapiens; identical to SEQ ID NO: 754701

SEQ ID NO: 754714 - protein, 194 aa, Homo sapiens
ISVQLPLRRRLQCTKMAAPVDLELKKAFTELQAKVIDTQQKVKLADIQIEQLNRTKKHAHLTDTEIMTLVDETNMYEGVGRMFILQSKEAIHSQLLEKQKIAEEKIKELEQKKSYLERSVKEAEDNIRPDGCFIWMAWQHHIFCITLSPICFPALEFLPGFACHLCPGHSSLSGCVMNSQEREDGSQGKIGSSA

SEQ ID NO: 754715 - protein, 117 aa, Homo sapiens
ISVQLPLRRRLQCTKMAAPVDLELKKAFTELQAKVIDTQQKVKLADIQIEQLNRTKKHAHLTDTEIMTLVDETNMYEGVGRMFILQSKEAIHSQLLEKQKIAEEKIKELEITFSASP

SEQ ID NO: 754716 - protein, 137 aa, Homo sapiens; identical to SEQ ID NO: 754701

SEQ ID NO: 754717 - protein, 137 aa, Homo sapiens; identical to SEQ ID NO: 754701

SEQ ID NO: 754718 - protein, 116 aa, Homo sapiens
ISVQLPLRRRLQCTKMAAPVDLELKKAFTELQAKVIDTQQKVKLADIQIEQLNRTKKHAHLTDTEIMTLVDETNMYEGVGRMFILQSKEAIHSQLLEKQKIAEEKIKELEVSFYWQ

SEQ ID NO: 754719 - protein, 109 aa, Homo sapiens [sequence omitted]

SEQ ID NO: 754720 - protein, 410 aa, Homo sapiens
SKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGK

SEQ ID NO: 754721 - protein, 117 aa, Homo sapiens
MKQSICHKVRCSCGMSTSLEQNCICFSQKRIPQGDFLLSTIIKIKQASLLAVIFYKCGLCMPFFQEVQYFQEVQKSSGRSNFTVEKPDSQHGLTKIDFTAAENCLKMRSSFSKNNRE

SEQ ID NO: 754722 - protein, 508 aa, Homo sapiens
MGSCCSCPDKDTVPDNHRNKFKVINVDDDGNELGSGIMELTDTELILYTRKRDSVKWHYLCLRRYGYDSNLFSFESGRRCQTGQGIFAFKCARAEELFNMLQEIMQNNSINVVEEPVVERNNHQTELEVPRTPRTPTTPGFAAQNLPNGYPRYPSFGDASSHPSSRHPSVGSARLPSVGEESTHPLLVAEEQVHTYVNTTGVQEERKNRTSVHVPLEARVSNAESSTPKEEPSSIEDRDPQILLEPEGVKFVLGPTPVQKQLMEKEKLEQLGRDQVSGSGANNTEWDTGYDSDERRDAPSVNKLVYENINGLSIPSASGVRRGRLTSTSTSDTQNINNSAQRRTALLNYENLPSLPPVWEARKLSRDEDDNLGPKTPSLNGYHNNLDPMHNYVNTENVTVPASAHKIEYSRRRDCTPTVFNFDIRRPSLEHRQLNYIQVDLEGGSDSDNPQTPKTPTTPLPQTPTRRTELYAVIDIERTAAMSNLQKALPRDDGTSRKTRHNSTDLPM

SEQ ID NO: 754723 - protein, 508 aa, Homo sapiens; identical to SEQ ID NO: 754722

SEQ ID NO: 754724 - protein, 117 aa, Homo sapiens; identical to SEQ ID NO: 754721

SEQ ID NO: 754725 - protein, 184 aa, Homo sapiens [sequence omitted]

SEQ ID NO: 754726 - protein, 225 aa, Homo sapiens
DWRRAPRSGWLPGSMEELSSVGEQVFAAECILSKRLRKGKLEYLVKWRGWSSKHNSWEPEENILDPRLLLAFQKKEHEKEVQNRKRGKRPRGRPRKLTAMSSCSRRSKLKVGGCAGYADPTSQHPLGVGGRQREGLGPSGRGWHFCQQSVPLLGKQEPPFFLSLSFCCQGPQPAESSSPPLPGASCFSLSCTPLCWVAGSNCCRQALFPPRGSLGDGKEQEACVQ

SEQ ID NO: 754727 - protein, 546 aa, Homo sapiens
DWRRAPRSGWLPGSMEELSSVGEQVFAAECILSKRLRKGKLEYLVKWRGWSSKHNSWEPEENILDPRLLLAFQKKEHEKEVQNRKRGKRPRGRPRKLTAMSSCSRRSKLKEPDAPSKSKSSSSSSSSTSSSSSSDEEDDSDLDAKRGPRGRETHPVPQKKAQILVAKPELKDPIRKKRGRKPLPPEQKATRRPVSLAKVLKTARKDLGAPASKLPPPLSAPVAGLAALKAHAKEACGGPSAMATPENLASLMKGMASSPGRGGISWQSSIVHYMNRMTQSQAQAASRLALKAQATNKCGLGLDLKVRTQKGELGMSPPGSKIPKAPSGGAVEQKVGNTGGPPHTHGASRVPAGCPGPQPAPTQELSLQVLDLQSVKNGMPGVGLLARHATATKGVPATNPAPGKGTGSGLIGASGATMPTDTSKSEKLASRAVAPPTPASKRDCVKGSATPSGQESRTAPGEARKAATLPEMSAGEESSSSDSDPDSASPPSTGQNPSVSVQTSQDWKPTRSLIEHVFVTDVTANLITVTVKESPTSVGFFNLRHY

SEQ ID NO: 754728 - protein, 502 aa, Homo sapiens [sequence omitted]

SEQ ID NO: 754729 - protein, 502 aa, Homo sapiens [sequence omitted]

SEQ ID NO: 754730 - protein, 502 aa, Homo sapiens [sequence omitted]

SEQ ID NO: 754731 - protein, 154 aa, Homo sapiens
NGREGVWHPRKGLSAQLLPRPRFCVFPDPALSSLPLEVPRPARHIVLDLGLGACAPPCMLDLPSLPPLAPGQGLGESLSATLRFMGVCFSPRQRLWESSCGLVLIGGLERQFPFGSEVRVLAWWGVASLQNLGLDFEKCHGATVPLPSAQVEER

SEQ ID NO: 754732 - protein, 502 aa, Homo sapiens [sequence omitted]

SEQ ID NO: 754733 - protein, 94 aa, Homo sapiens
IRAPHRAVRGRQAPPFTPRTYLLLVKDWLHSNYGPQTAPETWRTAVLALGCPWARLPALPVLQVLAVGPANNSLRPVWGPAQVDEAFLEEYHFP

SEQ ID NO: 754734 - protein, 502 aa, Homo sapiens [sequence omitted]

SEQ ID NO: 754735 - protein, 280 aa, Homo sapiens
MAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVKRCPPSKKRTQSIQGKGKGKRSSRANTVTPAVGRLEVSMVKPTPGLTPRFDSRVFKTPGLRTPAAGERIYNISGNGSPLADSKEIFLTVPVGGGESLRLLASDLQRHSIAQLDPEALGNIKKLSNRLAQICSSIRTHK

SEQ ID NO: 754736 - protein, 280 aa, Homo sapiens; identical to SEQ ID NO: 754735

SEQ ID NO: 754737 - protein, 224 aa, Homo sapiens
MAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVKRCPPSKKRTQSIQGKGKGKRSSRANTVTPAVGRLEVSMVKPTPGLTPRFDSRLQGLPDPGRLSASRDGYTSGWSLVEKESQ

SEQ ID NO: 754738 - protein, 280 aa, Homo sapiens; identical to SEQ ID NO: 754735

SEQ ID NO: 754739 - protein, 280 aa, Homo sapiens; identical to SEQ ID NO: 754735

SEQ ID NO: 754740 - protein, 281 aa, Homo sapiens
MAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVKRCPPSKKRTQSIQGKGKGKSPGKVQPCNILPSRGPWRCHGSNEFRLTTRFDSRVFKTPGLRTPAAGERIYNISGNGSPLADSKEIFLTVPVGGGESLRLLASDLQRHSIAQLDPEALGNIKKLSNRLAQICSSIRTHK

SEQ ID NO: 754741 - protein, 344 aa, Homo sapiens
MLFIGRSLGLFRTGRGFAQPLSRDRRYVPGDFFGWSPSALLVPTQFLASLPHLRRSPQPPPSAMAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVKRCPPSKKRTQSIQGKGKGKSPGQVQPCNILPSRGPWRCHGSNEFRLTTRFDSRVFKTPGLRTPAAGERIYNISGNGSPLADSKEIFLTVPVGGGESLRLLASDLQRHSIAQLDPEALGNIKKLSNRLAQICSSIRTHK

SEQ ID NO: 754742 - protein, 159 aa, Homo sapiens [sequence omitted]

SEQ ID NO: 754743 - protein, 211 aa, Homo sapiens
MAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVKRCPPSKKRTQSIQGKGKGKRVFKTPGLRTPAAGERIYNISGNGSPLADSKEIFLTVPVGGGEVKYFQG

SEQ ID NO: 754744 - protein, 145 aa, Homo sapiens
MAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVSGH

SEQ ID NO: 754745 - protein, 252 aa, Homo sapiens
MAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVKRCPPSKKRTQSIQGKGKGKSPGKVQPCNILPSRGPWRCHGSNEFRLTTRFDSRVFKTPGLRTPAAGERIYNISGNGSPLADSKEIFLTVPVGGGENRLAQICSSIRTHK

SEQ ID NO: 754746 - protein, 159 aa, Homo sapiens [sequence omitted]

SEQ ID NO: 754747 - protein, 280 aa, Homo sapiens; identical to SEQ ID NO: 754735

SEQ ID NO: 754748 - protein, 192 aa, Homo sapiens
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVNPASYHNVQIDLRDDPKTLARLLYMKEKPLTYEHGVKLAKAIGAQCYLECSALTQKGLKAVFDEAILTIFHPKKKKKRCSEGHSCCSII

SEQ ID NO: 754749 - protein, 119 aa, Homo sapiens
MNCKEGTDSSCGCRGNDEKKMLKCVVVGDGAVGKTCLLMSYANDAFPEEYVPTVFDHYAVGTYSSGTGRWVTDQQEVQAEGHGSAEDKYVVNMMYLDYGYVDLGASGRGSVPPWTIVVD

SEQ ID NO: 754750 - protein, 214 aa, Homo sapiens
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVNPASYHNVQEEWVPELKDCMPHVPYVLIGTQIDLRDDPKTLARLLYMKEKPLTYEHGVKLAKAIGAQCYLECSALTQKGLKAVFDEAILTIFHPKKKKKRCSEGHSCCSII

SEQ ID NO: 754751 - protein, 214 aa, Homo sapiens; identical to SEQ ID NO: 754750

SEQ ID NO: 754752 - protein, 214 aa, Homo sapiens; identical to SEQ ID NO: 754750

SEQ ID NO: 754753 - protein, 178 aa, Homo sapiens
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVNPASYHNVQEEWVPELKDCMPHVPYVLIGTQIDLRDDPKTLARLLYMKEKPLTYEHGVKLAKAVQSDLNFILNVC

SEQ ID NO: 754754 - protein, 214 aa, Homo sapiens; identical to SEQ ID NO: 754750

SEQ ID NO: 754755 - protein, 75 aa, Homo sapiens
RGGPQAVRDVGATTLLELQDTAGIDLRDDPKTLARLLYMKEKPLTYEHGVKLAKAKCLNWKRQAWAPPAPSKGKA

SEQ ID NO: 754756 - protein, 1337 aa, Homo sapiens
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 754757 - protein, 937 aa, Homo sapiens
GRVGREHWYKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 754758 - protein, 924 aa, Homo sapiens
ILEVSRLTSESLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 754759 - protein, 925 aa, Homo sapiens
LILCTRITKSVLHGCRQLANPEKHMSGRIAGFSGLSSLLSEYCIDMLPSLHRRLRVVSGPPRPGVSIRDLSLRILTRMLIRSPYCLFQALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 754760 - protein, 1337 aa, Homo sapiens; identical to SEQ ID NO: 754756

SEQ ID NO: 754761 - protein, 1337 aa, Homo sapiens; identical to SEQ ID NO: 754756

SEQ ID NO: 754762 - protein, 1337 aa, Homo sapiens; identical to SEQ ID NO: 754756

SEQ ID NO: 754763 - protein, 1337 aa, Homo sapiens; identical to SEQ ID NO: 754756

SEQ ID NO: 754764 - protein, 1247 aa, Homo sapiens
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKFKKGGKKKNFFKKNFFSLWGKIFPKGGA

SEQ ID NO: 754765 - protein, 600 aa, Homo sapiens
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVVSKSYFTLFL

SEQ ID NO: 754766 - protein, 373 aa, Homo sapiens
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTGKLAGLLHILA

SEQ ID NO: 754767 - protein, 71 aa, Homo sapiens
LTDRGRERTVNQKLSPRMDFTAQPKPATALCGVVSADGKIAYPPGVKEITDKITTDEMIKRLKGKTNCLFT

SEQ ID NO: 754768 - protein, 1040 aa, Homo sapiens
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 754769 - protein, 1337 aa, Homo sapiens; identical to SEQ ID NO: 754756

SEQ ID NO: 754770 - protein, 165 aa, Homo sapiens
PAVHPTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 754771 - protein, 1337 aa, Homo sapiens; identical to SEQ ID NO: 754756

SEQ ID NO: 754772 - protein, 1337 aa, Homo sapiens; identical to SEQ ID NO: 754756

SEQ ID NO: 754773 - protein, 842 aa, Homo sapiens
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEQEWNHCGLQMKSFPLSTSKVQANKFW

SEQ ID NO: 754774 - protein, 46 aa, Homo sapiens
MVVGSTGAGERQLVRPLAASGVSSCNGLSLAMEYHGKNLDLVPKSQ

SEQ ID NO: 754775 - protein, 242 aa, Homo sapiens
SVRRPAAAPAAVRPPAAGPPAAAPAVVYPAAAGPSAASLCAANPLVPAPAAVRPPVAGPPATAPAVVCPAAAGPSAASLCAANPPAVAPAAVRRPAATLGAASPAAVAPAAVCPAAASPSAASLCAASPTAAAPAAASPAAAAPLAVNPAAAAPAAACVQSVAESPATPLAIAQPVSSPAAPAPCAVPPLAAEPTALAYLPLHHWPTDVDPSTVLTIRIQEVGLMSFNRMELMFPMSPSPFH

SEQ ID NO: 754776 - protein, 656 aa, Homo sapiens
MADNLPTEFDVVIIGTGLPESILAAACSRSGQRVLHIDSRSYYGGNWASFSFSGLLSWLKEYQQNNDIGEESTVVWQDLIHETEEAITLRKKDETIQHTEAFPYASQDMEDNVEEIGALQKNPSLGVSNTFTEVLDSALPEESQLSYFNSDEMPAKHTQKSDTEISLEVTDVEESVEKEKYCGDKTCMHTVSDKDGDKDESKSTVEDKADEPIRNRITYSQIVKEGRRFNIDLVSKLLYSQGLLIDLLIKSDVSRYVEFKNVTRILAFREGKVEQVPCSRADVFNSKELTMVEKRMLMKFLTFCLEYEQHPDEYQAFRQCSFSEYLKTKKLTPNLQHFVLHSIAMTSESSCTTIDGLNATKNFLQCLGRFGNTPFLFPLYGQGEIPQGFCRMCAVFGGIYCLRHKVQCFVVDKESGRCKAIIDHFGQRINAKYFIVEDSYLSEETCSNVQYKQISRAVLITDQSILKTDLDQQTSILIVPPAEPGACAVRVTELCSSTMTCMKDTYLVHLTCSSSKTAREDLESVVKKLFTPYTETEINEEELTKPRLLWALYFNMRDSSGISRSSYNGLPSNVYVCSGPDCGLGNEHAVKQAETLFQEIFPTEEFCPPPPNPEDIIFDGDDKQPEAPGTNNVVMAKLESSEESKNLESPEKHLQN

SEQ ID NO: 754777 - protein, 656 aa, Homo sapiens; identical to SEQ ID NO: 754776

SEQ ID NO: 754778 - protein, 117 aa, Homo sapiens
WGPLNCTLGPAFIQPTSPAYLPPLLPRVARVATRVCFGLAGRASLLCPWTAEVYCPSLSWGISVQYMLYHFWDTLAPQDWATCPHLGSQNTPHSACRPPTRWAVVASVPCSTVSPQD

SEQ ID NO: 754779 - protein, 141 aa, Homo sapiens
SSSIKLSGWGMGRKAITCSAQRHLPFACSTSVRKAQLGTQRLLVSGPRNQLPSQGAGTHFSKLWKIMAKAMMQKCLMNTKASTSLKKGPSFSPQIPPCPCGHHTPTSLYLLEKRNRNEDLMSTSASVTKHSDYQCLGFLHH

SEQ ID NO: 754780 - protein, 100 aa, Homo sapiens
MTTQLRVVHLLPLLLACFVQTSPKQEKMKMDCHKDEKGTIYDYEAIALNKNEYVSFKQYVGKHILFVNVATYCGLTAQYPGMSVQGEDLYLVSSFLRKGM

SEQ ID NO: 754781 - protein, 221 aa, Homo sapiens
MTTQLRVVHLLPLLLACFVQTSPKQEKMKMDCHKDEKGTIYDYEAIALNKNEYVSFKQYVGKHILFVNVATYCGLTAQYPELNALQEELKPYGLVVLGFPCNQFGKQEPGDNKEILPGLKYVRPGGGFVPSFQLFEKGDVNGEKEQKVFSFLKHSCPHPSEILGTFKSISWDPVKVHDIRWNFEKFLVGPDGIPVMRWSHRATVSSVKTDILAYLKQFKTK

SEQ ID NO: 754782 - protein, 151 aa, Homo sapiens
MFLRLLQGFTELNALQEELKPYGLVVLGFPCNQFGKQEPGDNKEILPGLKYVRPGGGFVPSFQLFEKGDVNGEKEQKVFSFLKHSCPHPSEILGTFKSISWDPVKVHDIRWNFEKFLVGPDGIPVMRWSHRATVSSVKTDILAYLKQFKTK

SEQ ID NO: 754783 - protein, 208 aa, Homo sapiens
MSSPPSAARHSLCLQPDSGGPPELGSSPPVLCSNSSSLGSSTPTGAACAPGDYGRQALSPAEAEKRSGGKRKSDSSDSQEGNYKSEVNSKPRKERTAFTKEQIRELEAEFAHHNYLTRLRRYEIAVNLDLTERQVKVWFQNRRMKWKRVKGGQQGAAAREKELVNVKKGTLLPSELSGIGAATLQQTGDSIANEDSHDSDHSSEHAHL

SEQ ID NO: 754784 - protein, 208 aa, Homo sapiens; identical to SEQ ID NO: 754783

SEQ ID NO: 754785 - protein, 111 aa, Homo sapiens
SLKHALLNQYQKRTTKIVACFVGPSFVLGSVQGMSPELSLCLVPAPPLIGVDVFLNSLKQTVVTLASSADVLSTEQSASQAMLQSGWSMLLPTAEKQARALCSPALRSFRQ

SEQ ID NO: 754786 - protein, 111 aa, Homo sapiens; identical to SEQ ID NO: 754785

SEQ ID NO: 754787 - protein, 117 aa, Homo sapiens
MFSSLAKCCLPSCCCFSCGTAGHRRLTMSVPPRAPAPRFCPCCKGSRASFAGRMHPTPRATCTLKQTVVTLASSADVLSTEQSASQAMLQSGWSMLLPTAEKQARALCSPALRSFRQ

SEQ ID NO: 754788 - protein, 190 aa, Homo sapiens
MTASASSFSSSQGVQQPSIYSFSQITRSLFLSNGVAANDKLLLSSNRITAIVNASVGSGQRILRGLQYIKVPVTDARDSRLYDFFDPIADLIHTIDMRQGRTLLHCMAGVSRSASLCLAYLMKYHSMSLLDAHTWTKSRRPIIRPNNGFWEQLINYEFKLFNNNTVRMINSPVGNIPDIYEKDLRTMISM

SEQ ID NO: 754789 - protein, 73 aa, Homo sapiens
PFMIKLLNKLGTERTYLKIIKAIYDKLTANILNEEKLKAFFLRTGTRQECPLLPLLFNVVLEVLARTVRQEKK

SEQ ID NO: 754790 - protein, 759 aa, Homo sapiens
MESRSSPRLECSGAISAHCSLHLPDSSDFQLIFVFLVEMGFHHVGQAGLELLISSDLPTSASQSAGITDMKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 754791 - protein, 690 aa, Homo sapiens
MKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 754792 - protein, 690 aa, Homo sapiens; identical to SEQ ID NO: 754791

SEQ ID NO: 754793 - protein, 408 aa, Homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGASWGVS

SEQ ID NO: 754794 - protein, 599 aa, Homo sapiens; identical to SEQ ID NO: 751495

SEQ ID NO: 754795 - protein, 614 aa, Homo sapiens
QALGRQLVMLPCSPQIEAQCLSNYLNGALQGGAWLLLEKVHQLPPGLLSALGQRLGELHHLYAPLYQEASRNTSTIDPTQPQLLGSSFFEKHHVSVRLGYGCLLVLRALSSAVPANLHLLLRPVALALPDLRQVAELTLLGAGMRDAFQMATRLSKFFSLERELVSGPLPCRLPLLKQILEDTIRTLNVTKEEPKCQKPRSLAAIEEAAALLRSPLFSILNGLHLHNLRGLLCALFPSASQVLAEPMTYKLMKPLVVEELQQVGLDPSPDILGSLEQLSQALSRASGILLLGPAGSGKTTCWHSLFKIQNRLAAMEDTSTQGCQPVEITHLYPSGLSPQEFLGWLEGSCWHHGIFPKVLRAAGQCNNMGQKRQTEESIGIQHWIICDGASNGAWLDSITCLLSELPQLSLPSGQQIARPPGTFLLMEVADTTGISPTVVGCCALVWCGGEQTWQCILSALMASLPYEYRLQHRTVAELNHMAEVLVPATLRFLTCQGVSSLLQVHGQQAVCAGVAEVTSMARILHSLLDLHLRLKEEKAPGPEDLSYSDPVAQSFRSSKSSFLNRSQVDSDDVPDKCREHLLAVSSFLFALIWGFGAHLPSRYLPGWGMGDAEG

SEQ ID NO: 754796 - protein, 550 aa, Homo sapiens
QALGRQLVMLPCSPQIEAQCLSNYLNGALQGGAWLLLEKVHQLPPGLLSALGQRLGELHHLYAPLYQEASRNTSTIDPTQPQLLGSSFFEKHHVSVRLGYGCLLVLRALSSAVPANLHLLLRPVALALPDLRQVAELTLLGAGMRDAFQMATRLSKFFSLERELVSGPLPCRLPLLKQILEDTIRTLNVTKEEPKCQKPRSLAAIEEAAALLRSPLFSILNGLHLHNLRGLLCALFPSASQVLAEPMTYKLMKPLVVEELQQVGLDPSPDILGSLEQLSQALSRASGILLLGPAGSGKTTCWHSLFKIQNRLAAMEDTSTQGCQPVEITHLYPSGLSPQEFLGWLEGSCWHHGIFPKVLRAAGQCNNMGQKRQTEESIGIQHWIICDGASNGAWLDSITCLLSELPQLSLPSGQQIARPPGTFLLMEVADTTGISPTVVGCCALVWCGGEQTWQCILSALMASLPYEYRLQHRTVAELNHMAEVLVPATLRFLTCQGVSSLLQVHGQQAVCAGVAEVTSMARILHSLLDLHLRLKEEKAPGPGGKMDGLV

SEQ ID NO: 754797 - protein, 842 aa, Homo sapiens
QALGRQLVMLPCSPQIEAQCLSNYLNGALQGGAWLLLEKVHQLPPGLLSALGQRLGELHHLYAPLYQEASRNTSTIDPTQPQLLGSSFFEKHHVSVRLGYGCLLVLRALSSAVPANLHLLLRPVALALPDLRQVAELTLLGAGMRDAFQMATRLSKFFSLERELVSGPLPCRLPLLKQILEDTIRTLNVTKEEPKCQKPRSLAAIEEAAALLRSPLFSILNGLHLHNLRGLLCALFPSASQVLAEPMTYKLMKPLVVEELQQVGLDPSPDILGSLEQLSQALSRASGILLLGPAGSGKTTCWHSLFKIQNRLAAMEDTSTQGCQPVEITHLYPSGLSPQEFLGWLEGSCWHHGIFPKVLRAAGQCNNMGQKRQTEESIGIQHWIICDGASNGAWLDSITCLLSELPQLSLPSGQQIARPPGTFLLMEVADTTGISPTVVGCCALVWCGGEQTWQCILSALMASLPYEYRLQHRTVAELNHMAEVLVPATLRFLTCQGVSSLLQVHGQQAVCAGVAEVTSMARILHSLLDLHLRLKEEKAPGPGGKMEGWFERDGALRVAGVYSWSLGRVFFGGSGPGVKSNTVNLFSFFHLPPFSTGAPLVAMATFTEDLSYSDPVAQSFRSSKSSFLNRSQVDSDDVPDKCREHLLAVSSFLFALIWGFGAHLPSRFWPIFDTFIRDSISRLSNYPEPPPSALVFDLHVSPEDGTLVPFTGQYLSSHIKGTLGTFHPSIQTERLLYVVDLLLSGGQPVLLAGEAATGKSAFVEVLVEPHHPYIYSPIHPAFSSSHLRLLLSRGIQGQTQASPQPGHHQDSKPSLLFLLEDLHLATSGEELRRGKEGATVIS

SEQ ID NO: 754798 - protein, 551 aa, Homo sapiens
QALGRQLVMLPCSPQIEAQCLSNYLNGALQGGAWLLLEKVHQLPPGLLSALGQRLGELHHLYAPLYQEASRNTSTIDPTQPQLLGSSFFEKHHVSVRLGYGCLLVLRALSSAVPANLHLLLRPVALALPDLRQVAELTLLGAGMRDAFQMATRLSKFFSLERELVSGPLPCRLPLLKQILEDTIRTLNVTKEEPKCQKPRSLAAIEEAAALLRSPLFSILNGLHLHNLRGLLCALFPSASQVLAEPMTYKLMKPLVVEELQQVGLDPSPDILGSLEQLSQALSRASGILLLGPAGSGKTTCWHSLFKIQNRLAAMEDTSTQGCQPVEITHLYPSGLSPQEFLGWLEGSCWHHGIFPKVLRAAGQCNNMGQKRQTEESIGIQHWIICDGASNGAWLDSITCLLSELPQLSLPSGQQIARPPGTFLLMEVADTTGISPTVVGCCALVWCGGEQTWQCILSALMASLPYEYRLQHRTVAELNHMAEVLVPATLRFLTCQGVSSLLQVHGQQAVCAGVAEVTSMARILHSLLDLHLRLKEEKAPGPGSGPSLIPS

SEQ ID NO: 754799 - protein, 550 aa, Homo sapiens; identical to SEQ ID NO: 754796

SEQ ID NO: 754800 - protein, 643 aa, Homo sapiens
MGLLPKLGVSQGSDTSTSRAGRCARSVFGNIKVFVLCQGLLQLCQLLYSAYFKSSLTTIEKRFGLSSSSSGLISSLNEISNAILIIFVSYFGSRVHRPRLIGIGGLFLAAGAFILTLPHFLSEPYQYTLASTGNNSRLQAELCQKHWQDLPPSKCHSTTQNPQKETSSMWGLMVVAQLLAGIGTVPIQPFGISYVDDFSEPSNSPLYISILFAISVFGPAFGYLLGSIMLQIFVDYGRVNTAAVNLVPGDPRWIGAWWLGLLISSALLVLTSFPFFFFPRAMPIGAKRAPATADEARKLEEAKSRGSLVDFIKRFPCIFLRLLMNSLFVLVVLAQCTFSSVIAGLSTFLNKFLEKQYGTSAAYANFLIGAVNLPAAALGMLFGGILMKRFVFSLQTIPRIATTIITISMILCVPLFFMGCSTPTVAEVYPPSTSSSIHPQSPACRRDCSCPDSIFHPVCGDNGIEYLSPCHAGCSNINMSSATSKQLIYLNCSCVTGGSASAKTGSCPVPCAHFLLPAIFLISFVSLIACISHNPLYMMVLRVVNQEEKSFAIGVQFLLMRLLAWLPSPALYGLTIDHSCIRWNSLCLGRRGACAYYDNDALRDRYLGLQMGYKALGMLLLCFISWRVKKNKEYNVQKAAGLI

SEQ ID NO: 754801 - protein, 643 aa, Homo sapiens; identical to SEQ ID NO: 754800

SEQ ID NO: 754802 - protein, 643 aa, Homo sapiens; identical to SEQ ID NO: 754800

SEQ ID NO: 754803 - protein, 98 aa, Homo sapiens
LVKEKFRLHESYSAFQSHSWLPSPALYGLTIDHSCIRWNSLCLGRRGACAYYDNDALRDRYLGLQMGYKALGMLLLCFISWRVKKNKEYNVQKAAGLI

SEQ ID NO: 754804 - protein, 189 aa, Homo sapiens
FRHRRPKTRSPGGRKFQLAPGPPPPRSSLRLAASLAPMPPSWSPLMCGRAAEAAASSRTPGREMGQAVTRRLGAGARAAPRRAMDGRTPRPQDAPARRKPKAKAPLPPAETKYTDVSSAADSVESTAFIMEQKENMIDKDVELSVVLPGDIIKSTTVHGRYAGVNEISGPPLLIPPLKVSVIYVLMFVL

SEQ ID NO: 754805 - protein, 1167 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 754806 - protein, 1128 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPAGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 754807 - protein, 900 aa, Homo sapiens
MEQKENMIDKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPAGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 754808 - protein, 812 aa, Homo sapiens
PRFYHVSSMSVDETDKSPCEAGRVRAGSLQLSSMSAGNSSLRRTKRKAPSPPSKIPPHQSDENSRVTALQPVDGVPPDSASEANSPEELSSPAGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 754809 - protein, 1195 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRATSVTVFSKSSLQESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPGNIYGGTLLNLSSLSETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 754810 - protein, 360 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKVCSFVFYFVFLDEAVYHLFFLLPNIFSR

SEQ ID NO: 754811 - protein, 106 aa, Homo sapiens
MDGRTPRPQDAPARRKPKAKAPLPPAETKYTDVSSAADSVESTAFIMEQKENMIDKDVELSVVLPGDIIKSTTVHGRYAGVNEISGPPLLIPPLKVSVIYVLMFVL

SEQ ID NO: 754812 - protein, 1167 aa, Homo sapiens; identical to SEQ ID NO: 754805

SEQ ID NO: 754813 - protein, 1195 aa, Homo sapiens; identical to SEQ ID NO: 754809

SEQ ID NO: 754814 - protein, 1161 aa, Homo sapiens
FRHRRPKTRSPGGRKFQLAPGPPPPRSSLRLAASLAPMPPSWSPLMCGRAAEAAASSRTPGREMGQAVTRRLGAGARAAPRRAMDGRTPRPQDAPASKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRATSVTVFSKSSLQESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPAGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 754815 - protein, 1177 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRATSVTVFSKSSLQESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPGNIYGGTLLNLSSLSETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKGPSFTVMRQSSLTFQSSDPEQMRQSLLTAIRSGEAAAKLKRVTIPSNTISVNGRSRLSHSMSPDAQDGH

SEQ ID NO: 754816 - protein, 1169 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRATSVTVFSKSSLQESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPGNIYGGTLLNLSSLSETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRDG

SEQ ID NO: 754817 - protein, 382 aa, Homo sapiens
MVLGKVKSLTISFDCLNDSNVPVYSSGDTVSGRVNLEVTGEIRVKSLKIHARGHAKVRWTESRNAGSNTAYTQNYTEEVEYFNHKDILIGHERDDDNSEEGFHTIHSGRHEYAFSFELPQTPLATSFEGRHGSVRYWVKAELHRPWLLPVKLKKEFTVFEHIDINTPSLLSPQAGTKEKTLCCWFCTSGPISLSAKIERKGYTPGESIQIFAEIENCSSRMVVPKAAIYQTQAFYAKGKMKEVKQLVANLRGESLSSGKTETWNGKLLKIPPVSPSILDCSIIRVEYSLMVYVDIPGAMDLFLNLPLVIGTIPLHPFGSRTSSVSSQCSMNMNWLSLSLPERPEDMQTVVLEGLSQSHHKHSLVQDCSAFVPLLPLLHSWVV

SEQ ID NO: 754818 - protein, 414 aa, Homo sapiens
MVLGKVKSLTISFDCLNDSNVPVYSSGDTVSGRVNLEVTGEIRVKSLKIHARGHAKVRWTESRNAGSNTAYTQNYTEEVEYFNHKDILIGHERDDDNSEEGFHTIHSGRHEYAFSFELPQTPLATSFEGRHGSVRYWVKAELHRPWLLPVKLKKEFTVFEHIDINTPSLLSPQAGTKEKTLCCWFCTSGPISLSAKIERKGYTPGESIQIFAEIENCSSRMVVPKAAIYQTQAFYAKGKMKEVKQLVANLRGESLSSGKTETWNGKLLKIPPVSPSILDCSIIRVEYSLMVYVDIPGAMDLFLNLPLVIGTIPLHPFGSRTSSVSSQCSMNMNWLSLSLPERPEAPPSYAEVVTEEQRRNNLAPVSACDDFERALQGPLFAYIQEFRFLPPPLYSEIDPNPDQSADDRPSCPSR

SEQ ID NO: 754819 - protein, 414 aa, Homo sapiens; identical to SEQ ID NO: 754818

SEQ ID NO: 754820 - protein, 414 aa, Homo sapiens; identical to SEQ ID NO: 754818

SEQ ID NO: 754821 - protein, 225 aa, Homo sapiens
FTLLKTHPDPPRSDTMVSSCCGSVCSDQGCGQVLCQETCCRPSCCQTTCCRTTCYRPSCCVSSCCRPQCCQSVCCQPTCCRPSCCETTCCHPRCCISSCCRPSCCMSSCCKPQCCQSVCCQPTCCHPSCCISSCCRPSCCVSRCCRPQCCQSVCCQPTCCRPSCCISSCCRPSCCESSCCRPCCCRPCCCLRPVCGRVSCHTTCYRPTCVISTCPRPLCCASSCC

SEQ ID NO: 754822 - protein, 277 aa, Homo sapiens
MNGFASLLRRNQFILLVLFLLQIQSLGLDIDSRPTAEVCATHTISPGPKGDDGEKGDPGEEGKHGKVGRMGPKGIKGELGDMGDRGNIGKTGPIGKKGDKGEKGLLGIPGEKGKAGTVCDCGRYRKFVGQLDISIARLKTSMKFVKNVIAGIRETEEKFYYIVQEEKNYRESLTHCRIRGGMLAMPKDEAANTLIADYVAKSGFFRVFIGVNDLEREGQYMFTDNTPLQNYSNWNEGEPSDPYGHEDCVEMLSSGRWNDTECHLTMYFVCEFIKKKK

SEQ ID NO: 754823 - protein, 277 aa, Homo sapiens; identical to SEQ ID NO: 754822

SEQ ID NO: 754824 - protein, 463 aa, Homo sapiens
MVPALRYLVGACGRARGLFAGGSPGACGFASGRPRPLCGGSRSASTSSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRGLMAIDCPHTGIVDYRQVALSFAQDFQEAGGSVLTNFEVKGIEMAKESPSRSIDGMQYPIVIKNTKGEEIRCQYVVTCAGLYSDRISELSGCTPDPRIVPFRGDYLLLKPEKCYLVKGNIYPVPDSRFPFLGVHFTPRMDGSIWLGPNAVLAFKREGYRPFDFSATDVMDIIINSGLIKLASQNFSYGVTEMYKACFLGATVKYLQKFIPEITISDILRGPAGVRAQALDRDGNLVEDFVFDAGVGDIGNRILHVRNAPSPAATSSIAISGMIADEVQQRFEL

SEQ ID NO: 754825 - protein, 463 aa, Homo sapiens; identical to SEQ ID NO: 754824

SEQ ID NO: 754826 - protein, 489 aa, Homo sapiens
MVPALRYLVGACGRARGLFAGGSPGACGFASGRPRPLCGGSRSASTSSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRISSCVSITYQKTIIFPLCCSIAFMYQGLMAIDCPHTGIVDYRQVALSFAQDFQEAGGSVLTNFEVKGIEMAKESPSRSIDGMQYPIVIKNTKGEEIRCQYVVTCAGLYSDRISELSGCTPDPRIVPFRGDYLLLKPEKCYLVKGNIYPVPDSRFPFLGVHFTPRMDGSIWLGPNAVLAFKREGYRPFDFSATDVMDIIINSGLIKLASQNFSYGVTEMYKACFLGATVKYLQKFIPEITISDILRGPAGVRAQALDRDGNLVEDFVFDAGVGDIGNRILHVRNAPSPAATSSIAISGMIADEVQQRFEL

SEQ ID NO: 754827 - protein, 435 aa, Homo sapiens
MVPALRYLVGACGRARGLFAGGSPGACGFASGRPRPLCGGSRSASTSSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRGLMAIDCPHTGIVDYRQVALSFAQDFQEAGGSVLTNFEVKGIEMAKESPSRSIDGMQYPIVIKNTKGEEIRCQYVVTCAGLYSDRISELSGCTPDPRIVPFRGDYLLLKPEKCYLVKGNIYPVPDSRFPFLGVHFTPRMDGSIWLGPNAVLAFKREGYRPFDFSATDVMDIIINSGLIKLASQNFSYGVTEMYKACFLGATVKYLQKFIPEITISDILRQVAVRGPSWLWQQPMKVSDNNIYCFLWRCFGFAIDW

SEQ ID NO: 754828 - protein, 426 aa, Homo sapiens
MTQKDYITASSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRGLMAIDCPHTGIVDYRQVALSFAQDFQEAGGSVLTNFEVKGIEMAKESPSRSIDGMQYPIVIKNTKGEEIRCQYVVTCAGLYSDRISELSGCTPDPRIVPFRGDYLLLKPEKCYLVKGNIYPVPDSRFPFLGVHFTPRMDGSIWLGPNAVLAFKREGYRPFDFSATDVMDIIINSGLIKLASQNFSYGVTEMYKACFLGATVKYLQKFIPEITISDILRGPAGVRAQALDRDGNLVEDFVFDAGVGDIGNRILHVRNAPSPAATSSIAISGMIADEVQQRFEL

SEQ ID NO: 754829 - protein, 181 aa, Homo sapiens
MGLTISSLFSRLFGKKQMRILMVGLDAAGKTTILYKLKLGEIVTTIPTIGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCAATQGTGLYEGLDWLSNELSKR

SEQ ID NO: 754830 - protein, 181 aa, Homo sapiens; identical to SEQ ID NO: 754829

SEQ ID NO: 754831 - protein, 77 aa, Homo sapiens
SGRYYYYYSTPAAAPPKRFSNTACTSQRKIQNTTQLSCTEEIFPPTLTPGLHQPNLTLVGFGFDSQLVLCWLQRIDI

SEQ ID NO: 754832 - protein, 189 aa, Homo sapiens
MGLTISSLFSRLFGKKQMRILMVGLDAAGKTTILYKLKLGEIVTTIPTIGSFLFFFVGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCAATQGTGLYEGLDWLSNELSKR

SEQ ID NO: 754833 - protein, 104 aa, Homo sapiens
VPCVEICHTGLIFVVDSNDRERIQEVADELQKMLLVDELRDAVLLLFANKQDLPNAMAISEMTDKLGLQSLRNRTWYVQATCAATQGTGLYEGLDWLSNELSKR

SEQ ID NO: 754834 - protein, 181 aa, Homo sapiens; identical to SEQ ID NO: 754829

SEQ ID NO: 754835 - protein, 181 aa, Homo sapiens; identical to SEQ ID NO: 754829

SEQ ID NO: 754836 - protein, 181 aa, Homo sapiens; identical to SEQ ID NO: 754829

SEQ ID NO: 754837 - protein, 181 aa, Homo sapiens; identical to SEQ ID NO: 754829

SEQ ID NO: 754838 - protein, 181 aa, Homo sapiens; identical to SEQ ID NO: 754829

SEQ ID NO: 754839 - protein, 181 aa, Homo sapiens; identical to SEQ ID NO: 754829

SEQ ID NO: 754840 - protein, 181 aa, Homo sapiens; identical to SEQ ID NO: 754829

SEQ ID NO: 754841 - protein, 187 aa, Homo sapiens
RIPYIASGLTISSLFSRLFGKKQMRILMVGLDAAGKTTILYKLKLGEIVTTIPTIGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCAATQGTGLYEGLDWLSNELSKR

SEQ ID NO: 754842 - protein, 134 aa, Homo sapiens
MGGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCAATQGTGLYEGLDWLSNELSKR

SEQ ID NO: 754843 - protein, 181 aa, Homo sapiens; identical to SEQ ID NO: 754829

SEQ ID NO: 754844 - protein, 181 aa, Homo sapiens; identical to SEQ ID NO: 754829

SEQ ID NO: 754845 - protein, 181 aa, Homo sapiens; identical to SEQ ID NO: 754829

SEQ ID NO: 754846 - protein, 181 aa, Homo sapiens; identical to SEQ ID NO: 754829

SEQ ID NO: 754847 - protein, 181 aa, Homo sapiens; identical to SEQ ID NO: 754829

SEQ ID NO: 754848 - protein, 371 aa, Homo sapiens
ILLHINGYTRERSLISARSVGKASVNEVVSLSTRDSTLDRNPTSVLFVREASGIRVTLLFTGEFTVVEALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEEVPEEVRLAHVPGCSGHQKSERLRLLELRERREARAGAGGHEG

SEQ ID NO: 754849 - protein, 81 aa, Homo sapiens
ECVRVVPATSRGGAPPPVPIGLASMRFQRRFQRRYVWPMSRGAQVTKKARGLDCWSSGSVVKPGQGLVVMKDESWPPLGPC

SEQ ID NO: 754850 - protein, 700 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754851 - protein, 700 aa, Homo sapiens; identical to SEQ ID NO: 754850

SEQ ID NO: 754852 - protein, 627 aa, Homo sapiens [sequence omitted]

SEQ ID NO: 754853 - protein, 700 aa, Homo sapiens; identical to SEQ ID NO: 754850

SEQ ID NO: 754854 - protein, 622 aa, Homo sapiens
MEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754855 - protein, 599 aa, Homo sapiens
ALPLDAPGFAGVGPQLLEAQGRVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754856 - protein, 741 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEVFVTLGISPTLSWTIQRAEEQKNSKSFWTSRTKPETKDKAVFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754857 - protein, 532 aa, Homo sapiens
SILLFLCNLYPAMVEGYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754858 - protein, 590 aa, Homo sapiens
ILLHINGYTRERSLISARSVGKASVNEVVSLSTRDSTLDRNPTSVLFVREASGIRVTLLFTGEFTVVEALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754859 - protein, 417 aa, Homo sapiens
RARYPHSIPDVGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754860 - protein, 173 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLASQSAGIKRHEPPCLASFIFFFSFLFFLGGTESHSVAQDEVQWHDLDSLQPLPPGFK

SEQ ID NO: 754861 - protein, 134 aa, Homo sapiens
MSHHAWPLLSFSFLFFSFWGAQSLTLLPRMKCSGMISTHCNLYLLGSSDSPASASPVAGTTGTHQDARPIFVFLVETGFHHGGQAGLELLTSGDPPPSASQSARITGVATVPGCISVYFSVKLVNHPPHCTTVE

SEQ ID NO: 754862 - protein, 285 aa, Homo sapiens
AEVIYEDPNDGPQLSAGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754863 - protein, 310 aa, Homo sapiens
YRHYPWPVGVVHDMVSTYLLLWADSACVRWKRARRSSHHRLGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754864 - protein, 290 aa, Homo sapiens
LKFSSSSAALYIYLLKFSCTETNFSIYSSLSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 754865 - protein, 700 aa, Homo sapiens; identical to SEQ ID NO: 754850

SEQ ID NO: 754866 - protein, 700 aa, Homo sapiens; identical to SEQ ID NO: 754850

SEQ ID NO: 754867 - protein, 700 aa, Homo sapiens; identical to SEQ ID NO: 754850

SEQ ID NO: 754868 - protein, 700 aa, Homo sapiens; identical to SEQ ID NO: 754850

SEQ ID NO: 754869 - protein, 109 aa, Homo sapiens
MLGQGVAHEVARNGLHFLPQKTAIALMKLKRISADPLKALEEAGFKMPCQLHQVIVARFADDQLIIDFDNFVRCLVRLETLFKIFKQLDPENTGTIELDLISWLCFSVL

SEQ ID NO: 754870 - protein, 627 aa, Homo sapiens [sequence omitted]

SEQ ID NO: 754871 - protein, 712 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISLFSNHLFSSPKCTPGSLFS

SEQ ID NO: 754872 - protein, 594 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSARLVAKPG

SEQ ID NO: 754873 - protein, 481 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEEVPEEVRLAHVPGCSGHQKSERLRLLELRERREARAGAGGHEG

SEQ ID NO: 754874 - protein, 449 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQLEALNNSTKKEKVTEAHPARFVRKKICKGD

SEQ ID NO: 754875 - protein, 366 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTTSVCPWS

SEQ ID NO: 754876 - protein, 314 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVTAGADVQGSCCPDTMATGTVCGDAQGPARPHGGPVYTRAPHS

SEQ ID NO: 754877 - protein, 117 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLAGRHLPPLFG

SEQ ID NO: 754878 - protein, 301 aa, Homo sapiens
QRGAQPRARVPEPSRRGAGAVQAEVSERLAMAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEMNIQQLTNYRKSVMSLAEAGKLYRKDLEIVLCSEPPM

SEQ ID NO: 754879 - protein, 222 aa, Homo sapiens
QRGAQPRARVPEPSRRGAGAVQAEVSERLAMAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRIEAATLTSMSWMPF

SEQ ID NO: 754880 - protein, 209 aa, Homo sapiens
QRGAQPRARVPEPSRRGAGAVQAEVSERLAMAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRA

SEQ ID NO: 754881 - protein, 277 aa, Homo sapiens
QRGAQPRARVPEPSRRGAGAVQAEVSERLAMAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKEMNIQQLTNYRKSVMSLAEAGKLYRKDLEIVLCSEPPM

SEQ ID NO: 754882 - protein, 246 aa, Homo sapiens
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 754883 - protein, 246 aa, Homo sapiens; identical to SEQ ID NO: 754882

SEQ ID NO: 754884 - protein, 246 aa, Homo sapiens; identical to SEQ ID NO: 754882

SEQ ID NO: 754885 - protein, 233 aa, Homo sapiens
MIDVPHSTSVTWRTVLVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 754886 - protein, 241 aa, Homo sapiens
MLKGRLLTKIFRFAFNVYLFGVLQVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 754887 - protein, 246 aa, Homo sapiens; identical to SEQ ID NO: 754882

SEQ ID NO: 754888 - protein, 246 aa, Homo sapiens; identical to SEQ ID NO: 754882

SEQ ID NO: 754889 - protein, 246 aa, Homo sapiens; identical to SEQ ID NO: 754882

SEQ ID NO: 754890 - protein, 266 aa, Homo sapiens
MGDREQLLQRARLAEQAERYDDMASAMKAVTELNEPLSNEDRNLLSVAYKNVVGARRSSWRVISSIEQKTMADGNEKKLEKVKAYREKIEKELETVCNDGSPLGGFPLFPFGGFLVNQRAFPWIKENLVKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 754891 - protein, 142 aa, Homo sapiens
MVETLKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 754892 - protein, 230 aa, Homo sapiens
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKFSVFYYEIQNAPEQACLLAKQAFDDAIAELDTLNEDSYKDSTLIMQLLRDNLTLWTSDQQDEEAGEGN

SEQ ID NO: 754893 - protein, 246 aa, Homo sapiens; identical to SEQ ID NO: 754882

SEQ ID NO: 754894 - protein, 736 aa, Homo sapiens
LKLCNPSAHALRSALPGRHGRAAQEVGPAPGRLRDASARGAGTPESQQARRPAEGEPIAPREIRGSGRGPGGSRAEPRPGVWGRSPACLQLPSLGSSSCARDPGGGGGRRSCSWTVAAGGRGPGSPGGAALGRLADRGHAVLTESLGRRGAAAGAPSREGAPERRQQHFICDSPAQREAKRFTMEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 754895 - protein, 713 aa, Homo sapiens
LKLCNPSAHALRSALPGRHGRAAQEVGPAPGRLRDASARGAGTPESQQARRPAEGEPIAPREIRGSGRGPGGSRAEPRPGVWGRSPACLQLPSLGSSSCARDPGGGGGRRSCSWTVAAGGRGPGSPGGAALGRLADRGHAVLTESLGRRGAAAGAPSREGAPERRQQHFICDSPAQREAKRFTMEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 754896 - protein, 724 aa, Homo sapiens
LKLCNPSAHALRSALPGRHGRAAQEVGPAPGRLRDASARGAGTPESQQARRPAEGEPIAPREIRGSGRGPGGSRAEPRPGVWGRSPACLQLPSLGSSSCARDPGGGGGRRSCSWTVAAGGRGPGSPGGAALGRLADRGHAVLTESLGRRGAAAGAPSREGAPERRQQHFICDSPAQREAKRFTMEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPMWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 754897 - protein, 378 aa, Homo sapiens
MEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 754898 - protein, 736 aa, Homo sapiens; identical to SEQ ID NO: 754894

SEQ ID NO: 754899 - protein, 517 aa, Homo sapiens
LKLCNPSAHALRSALPGRHGRAAQEVGPAPGRLRDASARGAGTPESQQARRPAEGEPIAPREIRGSGRGPGGSRAEPRPGVWGRSPACLQLPSLGSSSCARDPGGGGGRRSCSWTVAAGGRGPGSPGGAALGRLADRGHAVLTESLGRRGAAAGAPSREGAPERRQQHFICDSPAQREAKRFTMEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTFTSTRTTHSPEIECEDTR

SEQ ID NO: 754900 - protein, 736 aa, Homo sapiens; identical to SEQ ID NO: 754894

SEQ ID NO: 754901 - protein, 269 aa, Homo sapiens
LKLCNPSAHALRSALPGRHGRAAQEVGPAPGRLRDASARGAGTPESQQARRPAEGEPIAPREIRGSGRGPGGSRAEPRPGVWGRSPACLQLPSLGSSSCARDPGGGGGRRSCSWTVAAGGRGPGSPGGAALGRLADRGHAVLTESLGRRGAAAGAPSREGAPERRQQHFICDSPAQREAKRFTMEPVTKWSPKQVVDWTRGLDDCLQQYVHKFEREKINGEQLLQISHQDLEELGVTRIGHQELVLEAVDLLCALVSSGKDGLYRDDVL

SEQ ID NO: 754902 - protein, 30 aa, Homo sapiens
MSTADKTALTVVISPTLQIGLLRFLVIELH

SEQ ID NO: 754903 - protein, 59 aa, Homo sapiens
GFTLVLTPRHLLMGEGNGATLVQEVSVDGWQGVSPSRKSRAPGGSRQGHEGSWNLYQGP

SEQ ID NO: 754904 - protein, 101 aa, Homo sapiens
GYSPQLRQKSLKLSISFNSNFPHWTAEVTSWLHPNNFQFFRFFCLFHFFSPISLDLPFKSCLCFKIFPYRSSLLASSPFLLSLGSHRHKMDTKTLFIQVFY

SEQ ID NO: 754905 - protein, 77 aa, Homo sapiens
KNAVIKADGKKRMLILKKALKSDIGQYTCDCGTDKTSGKLDIEDREIKLVRPLHSVEVMETETARFETEISEDDIHA

SEQ ID NO: 754906 - protein, 110 aa, Homo sapiens
MGYDRGSAQLQLDFLTKTLGRGFRLLHLDVGDREPVRERHQRGDARKGPLVPFPNQKSEAAEPPKTPPSSCDSTNAAIAKQALKKPIKGKQAPRKKAQGKTQQNHKLTDF

SEQ ID NO: 754907 - protein, 109 aa, Homo sapiens
VTHHEVKCQGKPLAGIYRKREEKRNTGNAVQSAMKSKKQKIKDARKGPLVPFPNQKSEAAEPPKTPPSSCDSTNAAIAKQALKKPIKGKQAPRKKAQGKTQQNHKLTDF

SEQ ID NO: 754908 - protein, 79 aa, Homo sapiens
MLKKRHSPSAHASWAIVPTAIILQDAVGYSLGGHLEFTVFVWVWWLMLVILELWEAEAGRLLEVREFKTNLANVAKPRL

SEQ ID NO: 754909 - protein, 122 aa, Homo sapiens
YKIPHTTLSIPVPNNIMWSPLSDSSSSSSTLSAFGPASYFSGGMEQIRREFLHAPQQHGCPPLCVCTHTAAFLPVLWMTCLSWLQPPLSLCARSHSFSFTQGHHSAIIPSPSFNLRCFLSIG

SEQ ID NO: 754910 - protein, 111 aa, Homo sapiens
LTASCYTFQEVNQWQTATYFLMDSKPRALLRPLIPAPWSFLPVKAKRGRREEPPLTMLRKAFILLRVDEPICILGPCPASGKVSWSQQRMNQSHTGEGWSRTPIFEHFPDT

SEQ ID NO: 754911 - protein, 98 aa, Homo sapiens
KKLLFDSSSCFTIGQPDTRMSTKKSPEELKRIFEKYAAKEGDPDQLSKDELKLLIQAEFPSLLKGPNTLDDLFQELDKNGDGEVSFEEFQVLVKKISQ

SEQ ID NO: 754912 - protein, 108 aa, Homo sapiens
MLAPKALWAIKSVMWQRPLDSQSSFLPGELQGLLCRHLPVIVSVIHTSTQTFSWCFPLPWAPVSITEDGDSWETPAWMSVEAMGPLPPQVSGLRSCSFHRNECPFPCL

SEQ ID NO: 754913 - protein, 148 aa, Homo sapiens
EQTLQNLEQSYVETIDWDLAKSQACSATRSIMCALNAGEAFARDQTLSSTRGHTPGRSHTCVLSVGVGLSRRPPSPYTRGSTRGRSRMCAGNVGDTSGIHPLFTKSQEGFHSGGGGPFVIVQGVVGRGFSPGRIRPSFLHQRTHLEEK

SEQ ID NO: 754914 - protein, 134 aa, Homo sapiens
RLECSGAISAHHSLHLVGSSDSPASASWVAEITGTYHHAQLIFVFLVELGFHHVGQAGLELQTLGDLPTSASQSARITGVCHCARPEEKLSKRQEHFLELIEQEPSVCKGTPLRETSLKNVKIATLTEILELLR

SEQ ID NO: 754915 - protein, 125 aa, Homo sapiens
GTPAPPSPAPSARLPPTQAEKRFPYTEKARPMEISVKSTIYDPACNPSPQLGAVEGGDALCPSQLHPSSPSLTVPVLDLKRIDPWGTPHLPNPDFGAGGSCKTNQNTDDKEDIAVYTPGRGGAEF

SEQ ID NO: 754916 - protein, 95 aa, Homo sapiens
AAAYYYYCSNSSFYRCTGTCYLLLPYVGWGGNLSGLHISPSLTVPVLDLKRIDPWGTPHLPNPDFGAGGSCKTNQNTDDKEDIAVYTPGRGGAEF

SEQ ID NO: 754917 - protein, 84 aa, Homo sapiens
GTPAPPSPAPSARLPPTQAEKRFPYTEKARPMEISVKSTIYDPACNPSPQLGAVEGGDALCPSQLHPSSLLQGCEHPLPVLVSA

SEQ ID NO: 754918 - protein, 115 aa, Homo sapiens
MPPIRVIWLQADRLNGYLNPNFQSITFFLSTSALSGPPRPPQPLVHKALPKTPLSLHRTEWLQALLPYLSTATCLGPPARLLAPFALAPHPRLPPQDGAIFLAPLSPHRSQPSTC

SEQ ID NO: 754919 - protein, 341 aa, Homo sapiens
VPARKPGSGARAARASAAAVAAAATLTPPTMDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSQAGACQSQGQALQVQHPQAGGGESLSAPFTCNCIVTSDNLTLVNSVSMFLFFQ

SEQ ID NO: 754920 - protein, 311 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSQAGACQSQGQALQVQHPQAGGGESLSAPFTCNCIVTSDNLTLVNSVSMFLFFQ

SEQ ID NO: 754921 - protein, 336 aa, Homo sapiens
MDSFDLALLQEWDLESLWGEDILNQRNDSLVVEFQSSASRCRSVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSQAGACQSQGQALQVQHPQAGGGESLSAPFTCNCIVTSDNLTLVNSVSMFLFFQ

SEQ ID NO: 754922 - protein, 905 aa, Homo sapiens [sequence omitted]

SEQ ID NO: 754923 - protein, 746 aa, Homo sapiens
MPCLGLLANLCRHNLSVQTHIKTLSNVKSFYRTLITLLAHSSLTVVVFALSILSSLTLNEEVGEKLFHARNIHQTFQLIFNILINGDGTLTRKYSVDLLMDLLKNPKIADYLTRYEHFSSCLHQVLGLLNGKDPDSSSKVLELLLAFCSVTQLRHMLTQMMFEQSPPGSATLGSHTKCLEPTVALLRWLSQPLDGSENCSVLALELFKEIFEDVIDAANCSSADRFVTLLLPTILDQLQFTEQNLDEALTRKKCERIAKAIEVLLTLCGDDTLKMHIAKILTTVKCTTLIEQQFTYGKIDLGFGTKVADSELCKLAADVILKTLDLINKLKPLVPGMEVSFYKILQDPRLITPLAFALTSDNREQVQSGLRILLEAAPLPDFPALVLGESIAANNAYRQQETEHIPRKMPWQSSNHSFPTSIKCLTPHLKDGVPGLNIEELIEKLQSGMVVKDQICDVRISDIMDVYEMKLSTLASKESRLQDLLETKALALAQADRLIAQHRCQRTQAETEARTLASMLREVERKNEELSVLLKAQQVESERAQSDIEHLFQHNRKLESVAEEHEILTKSYMELLQRNESTEKKNKDLQITCDSLNKQIETVKKLNESLKEQNEKSIAQLIEKEEQRKEVQNQLVDREHKLANLHQKTKVQEEKIKTLQKEREDKEETIDILRKELSRTEQIRKELSIKASSLEVQKAQLEGRLEEKESLVKLQQEELNKHSHMIAMIHSLSGGKINPETVNLSI

SEQ ID NO: 754924 - protein, 905 aa, Homo sapiens [sequence omitted]

SEQ ID NO: 754925 - protein, 448 aa, Homo sapiens
MSIWDSYKVADSELCKLAADVILKTLDLINKLKPLVPGMEVSFYKILQDPRLITPLAFALTSDNREQVQSGLRILLEAAPLPDFPALVLGESIAANNAYRQQETEHIPRKMPWQSSNHSFPTSIKCLTPHLKDGVPGLNIEELIEKLQSGMVVKDQICDVRISDIMDVYEMKLSTLASKESRLQDLLETKALALAQADRLIAQHRCQRTQAETEARTLASMLREVERKNEELSVLLKAQQVESERAQSDIEHLFQHNRKLESVAEEHEILTKSYMELLQRNESTEKKNKDLQITCDSLNKQIETVKKLNESLKEQNEKSIAQLIEKEEQRKEVQNQLVDREHKLANLHQKTKVQEEKIKTLQKEREDKEETIDILRKELSRTEQIRKELSIKASSLEVQKAQLEGRLEEKESLVKLQQEELNKHSHMIAMIHSLSGGKINPETVNLSI

SEQ ID NO: 754926 - protein, 746 aa, Homo sapiens; identical to SEQ ID NO: 754923

SEQ ID NO: 754927 - protein, 787 aa, Homo sapiens
MDSTACLKSLLLTVSQYKAVKSEANATQLLRHLEVISGQKLTRLFTSNQILTSECLSCLVELLEDPNISASLILSIIGLLSQLAVDIETRDCLQNTYNLNSVLAGVVCRSSHTDSVFLQCIQLLQKLTYNVKIFYSGANIDELITFLIDHIQSSEDELKMPCLGLLANLCRHNLSVQTHIKTLSNVKSFYRTLITLLAHSSLTVVVFALSILSSLTLNEEVGEKLFHARNIHQTFQLIFNILINGDGTLTRKYSVDLLMDLLKNPKIADYLTRYEHFSSCLHQVLGLLNGKDPDSSSKVLELLLAFCSVTQLRHMLTQMMFEQSPPGSATLGSHTKCLEPTVALLRWLSQPLDGSENCSVLALELFKEIFEDVIDAANCSSADRFVTLLLPTILDQLQFTEQNLDEALTRKKCERIAKAIEVLLTLCGDDTLKMHIAKILTTVKCTTLIEQQFTYGKIDLGFGTKVADSELCKLAADVILKTLDLINKLKPLVPGMEVSFYKILQDPRLITPLAFALTSDNREQVQSGLRILLEAAPLPDFPALVLGESIAANNAYRQQETEHIPRKMPWQSSNHSFPTSIKCLTPHLKDGVPGLNIEELIEKLQSGMVVKDQICDVRISDIMDVYEMKLSTLASKESRLQDLLETKALALAQADRLIAQHRCQRTQAETEARTLASMLREVERKNEELSVLLKAQQVESERAQSDIEHLFQHNRKLESVAEEHEILTKSYMELLQRNESTEKKNKDLQITCDSLNKQIETVKKLNESLKEQNEKFASKNKSTRRKD

SEQ ID NO: 754928 - protein, 286 aa, Homo sapiens
MDSTACLKSLLLTVSQYKAVKSEANATQLLRHLEVISGQKLTRLFTSNQILTSECLSCLVELLEDPNISASLILSIIGLLSQLAVDIETRDCLQNTYNLNSVLAGVVCRSSHTDSVFLQCIQLLQKLTYNVKIFYSGANIDELITFLIDHIQSSEDELKMPCLGLLANLCRHNLSVQTHIKTLSNVKSFYRTLITLLAHSSLTVVVFALSILSSLTLNEEVGEKLFHARNIHQTFQLIFNILINGDGTLTRKYSVDLLMDLLKNPKIADYLTRYDSLQSILELFYF

SEQ ID NO: 754929 - protein, 423 aa, Homo sapiens
MAGKVKWVTDIEKSVLINNFEKRGWVQVTENEDWNFYWMSVQTIRNVFSVEAGYRLSDDQIVNHFPNHYELTRKDLMVKNIKRYRKELEKEGSPLAEKDENGKYLYLDFVPVTYMLPADYNLFVEEFRKSPSSTWIMKPCGKAQGKGIFLINKLSQIKKWSRDSKTSSFVSQSNKEAYVISLYINNPLLIGGRKFDLRLYVLVSTYRPLRCYMYKLGFCRFCTVKYTPSTSELDNMFVHLTNVAIQKHGEDYNHIHGGKWTVSNLRLYLESTRGKEVTSKLFDEIHWIIVQSLKAVAPVMNNDKHCFECYGYDIIIDDKLKPWLIEVNASPSLTSSTANDRILKYNLINDTLNIAVPNGEIPDCKWNKSPPKEVLGNYEILYDEELAQGDGADRELRSRQGQSLGPRAGRSRDSGRAVLTTWK

SEQ ID NO: 754930 - protein, 127 aa, Homo sapiens
MPVMNNDKHCFECYGYDIIIDDKLKPWLIEVNASPSLTSSTANDRILKYNLINDTLNIAVPNGEIPDCKWNKSPPKEVLGNYEILYDEELAQGDGADRELRSRQGQSLGPRAGRSRDSGRAVLTTWK

SEQ ID NO: 754931 - protein, 423 aa, Homo sapiens; identical to SEQ ID NO: 754929

SEQ ID NO: 754932 - protein, 385 aa, Homo sapiens
MSVQTIRNVFSVEAGYRLSDDQIVNHFPNHYELTRKDLMVKNIKRYRKELEKEGSPLAEKDENGKYLYLDFVPVTYMLPADYNLFVEEFRKSPSSTWIMKPCGKAQGKGIFLINKLSQIKKWSRDSKTSSFVSQSNKEAYVISLYINNPLLIGGRKFDLRLYVLVSTYRPLRCYMYKLGFCRFCTVKYTPSTSELDNMFVHLTNVAIQKHGEDYNHIHGGKWTVSNLRLYLESTRGKEVTSKLFDEIHWIIVQSLKAVAPVMNNDKHCFECYGYDIIIDDKLKPWLIEVNASPSLTSSTANDRILKYNLINDTLNIAVPNGEIPDCKWNKSPPKEVLGNYEILYDEELAQGDGADRELRSRQGQSLGPRAGRSRDSGRAVLTTWK

SEQ ID NO: 754933 - protein, 394 aa, Homo sapiens
MAGKVKWVTDIEKSVLINNFEKRGWVQVTENEDWNFYWMSVQTIRNVFSVEAGYRLSDDQIVNHFPNHYELTRKDLMVKNIKRYRKELEKEGSPLAEKDENGKYLYLDFVPVTYMLPADYNLFVEEFRKSPSSTWIMKPCGKAQGKGIFLINKLSQIKKWSRDSKTSSFVSQSNKEAYVISLYINNPLLIGGRKFDLRLYVLVSTYRPLRCYMYKLGFCRFCTVKYTPSTSELDNMFVHLTNVAIQKHGEDYNHIHGGKWTVSNLRLYLESTRGKEVTSKLFDEIHWIIVQSLKAVAVNASPSLTSSTANDRILKYNLINDTLNIAVPNGEIPDCKWNKSPPKEVLGNYEILYDEELAQGDGADRELRSRQGQSLGPRAGRSRDSGRAVLTTWK

SEQ ID NO: 754934 - protein, 396 aa, Homo sapiens
MSVQTIRNVFSVEAGYRLSDDQIVNHFPNHYELTRKDLMVKNIKRYRKELEKEGSPLAEKDENGKYLYLGLCVFHRLMFFNFVPVTYMLPADYNLFVEEFRKSPSSTWIMKPCGKAQGKGIFLINKLSQIKKWSRDSKTSSFVSQSNKEAYVISLYINNPLLIGGRKFDLRLYVLVSTYRPLRCYMYKLGFCRFCTVKYTPSTSELDNMFVHLTNVAIQKHGEDYNHIHGGKWTVSNLRLYLESTRGKEVTSKLFDEIHWIIVQSLKAVAPVMNNDKHCFECYGYDIIIDDKLKPWLIEVNASPSLTSSTANDRILKYNLINDTLNIAVPNGEIPDCKWNKSPPKEVLGNYEILYDEELAQGDGADRELRSRQGQSLGPRAGRSRDSGRAVLTTWK

SEQ ID NO: 754935 - protein, 423 aa, Homo sapiens; identical to SEQ ID NO: 754929

SEQ ID NO: 754936 - protein, 385 aa, Homo sapiens; identical to SEQ ID NO: 754932

SEQ ID NO: 754937 - protein, 141 aa, Homo sapiens
GYHGDGLNAVILFASCYLPRSSIPNYTYVMEHLFRYMVGTLELLVAENYLLVHLSGGTSRAQVPPLSWIRQCYRTLDRRLRKNLRALVVVHATWYVKAFLALLRPFISSKFTRKIRFLDSLGELAQLISLDQVHIPEAVRQ

SEQ ID NO: 754938 - protein, 91 aa, Homo sapiens
MPSLLGAPPYSGLGGVGDPYVPLMVLMCRVCLEDKPIKPLPCCKKAVCEECLKVYLSAQTESHSVTRLECSGMISAHGNLHIPGSSDSPAS

SEQ ID NO: 754939 - protein, 242 aa, Homo sapiens
MRLGTRSALWACRGWRQQHMHAWLTEQPLGVLFPEELYGDFEDLETGDMHKGKSGPDTQNEDIENKEEIDPDEEESAKKKHLDKKRKLKEMFDAEYDEGESTYFDDLKGEMQKEAQLNHVEFEDQDDEARVQYDGFRPGMYVRVEIENVPCEFVQNFDPHYPIILGGLGNSEGNVGHVQMRLKKHRWYKKILKSQDPIIFSVGWRRFQTILLYYIEDHNGRQRLLKYTPQHMHCGAAFWGKI

SEQ ID NO: 754940 - protein, 836 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754941 - protein, 836 aa, Homo sapiens; identical to SEQ ID NO: 754940

SEQ ID NO: 754942 - protein, 832 aa, Homo sapiens
MNIVLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754943 - protein, 866 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLACKKYWLYLRLLGICLLGSERNFSPAIVLQRHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754944 - protein, 538 aa, Homo sapiens
MLREKFPEFCSSPSPPVEEDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754945 - protein, 866 aa, Homo sapiens; identical to SEQ ID NO: 754943

SEQ ID NO: 754946 - protein, 836 aa, Homo sapiens; identical to SEQ ID NO: 754940

SEQ ID NO: 754947 - protein, 820 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDHDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754948 - protein, 759 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMK

SEQ ID NO: 754949 - protein, 397 aa, Homo sapiens
GRVGRPTRPIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754950 - protein, 836 aa, Homo sapiens; identical to SEQ ID NO: 754940

SEQ ID NO: 754951 - protein, 836 aa, Homo sapiens; identical to SEQ ID NO: 754940

SEQ ID NO: 754952 - protein, 312 aa, Homo sapiens
KSASRGRCEFGGGSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754953 - protein, 343 aa, Homo sapiens
TFMKQIAGGDVTAKNIWLAESVLDILTEQREWVLKSSILIAMAVYTYLRFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754954 - protein, 783 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKSTCSGVL

SEQ ID NO: 754955 - protein, 146 aa, Homo sapiens
MASKTLGSRVEEKEGLGLGAEKRMGGAVGAAGSHSKSYRSFSLDSVISSPWRRNMRTLPPSHPRAGEKQLCPALEVERMPHSPPMPKKSRAPAVLQKRKTRNRSLPSGNEKGPLQWALTVTEALHSPSHPRLDCPLLLGDSKVNRG

SEQ ID NO: 754956 - protein, 704 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQSQELGLPVMMGTWVCSEKIQSQIIIQSLTGKPCAVWPETFGTKFPWDNNSQNEETTINIGTPKAPRGDKRTPPKKAAGRRYIAVGRDAHLTYKTNHRQGTITKVAAKPLKKRATQSEQTRRQSRVDRQTSHEQRSTTNR

SEQ ID NO: 754957 - protein, 577 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCRMRETDCRQKQNQNQPLPTSPKLPLKNCSEKQGISLCKLIPCVVHGCHVITYSLVYLFPAL

SEQ ID NO: 754958 - protein, 240 aa, Homo sapiens
LTGQRAFASPGTYQYLTVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCRMRETDCRQKQNQNQPLPTSPKLPLKNCSEKQGISLVLSKLFFPRVCLHKTCHLELACTI

SEQ ID NO: 754959 - protein, 334 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDILHSRKDMNNTETAFSAV

SEQ ID NO: 754960 - protein, 185 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTVRAKDTGW

SEQ ID NO: 754961 - protein, 73 aa, Homo sapiens
MNLYESFAQATQLGDLHTCLMMDMKACQEDDVRLLCHLTPSIYTEVSACIRICAGGLTGTHLSEHSEYTQTLN

SEQ ID NO: 754962 - protein, 83 aa, Homo sapiens
MTAGVSEREANDALNAYVCKGLPQHEEICLGLFTLILTEPAQAQKCYRDLALVSRDGMNIVLNKINQILMEKYLKLQDTCRTQ

SEQ ID NO: 754963 - protein, 895 aa, Homo sapiens
MSIVTSMTAGVSEREANDALNAYVCKGLPQHEEICLGLFTLILTEPAQAQKCYRDLALVSRDGMNIVLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754964 - protein, 734 aa, Homo sapiens
METKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754965 - protein, 673 aa, Homo sapiens
IRYHQSRLALTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754966 - protein, 529 aa, Homo sapiens
MEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754967 - protein, 836 aa, Homo sapiens; identical to SEQ ID NO: 754940

SEQ ID NO: 754968 - protein, 902 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNCMPSTLGVQCRRCCPGPDYAWSQAGGRGRTPGATTHTRDKTTCACCLISSQTSDCFSFPALPFLPLVFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754969 - protein, 287 aa, Homo sapiens
LEDTRNTVDGCYDSATLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 754970 - protein, 576 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCRMRETDCRQKQNQNQPLPTSPKLPLKNCSEKQGISLVLSKLFFPRVCLHKTCHLELACTI

SEQ ID NO: 754971 - protein, 541 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCSALRMRETDYVGFHGPKLTPHTAPN

SEQ ID NO: 754972 - protein, 208 aa, Homo sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIGM

SEQ ID NO: 754973 - protein, 47 aa, Homo sapiens
VFLHSLRSSSSKLAQLTLEQILEHLDNLRLNLTNTKQNCMPSTLGVQ

SEQ ID NO: 754974 - protein, 147 aa, Homo sapiens
MLFFINVQTKKDTSKERTYAFLVNTRHPKIRRQIEQGMDMVISSVIGESYRLQFDFQEAVKNFFPPGNEVVNGENLSFAYEFKADALFDFFYWFGLSNSVVKVNGKSSIDDVFNCNLSPRSSLTEPLLAELPFPSVLESEETPNQFI

SEQ ID NO: 754975 - protein, 329 aa, Homo sapiens
ASGSLGGAARAVRLAPERPPRPGQAGRPTPSSPRARLTQAGRPAPPGDHQVPAGGCRHRTEAGGVRTDDAGMAGAACEPVARPSLTSISSGELRSLWTCDCELALLPLAQLLRLQPGAFQLSGDQLVVAGPGEPAAARGGFNVFGDGLVRLDGQLYRLSSYIKRYVELTNYCDYKDYRETILSKPMLFFINVQTKKDTSKERTYAFLVNTRHPKIRRQIEQGMDMVISSVIGESYRLQFDFQEAVKNFFPPGNEVVNGENLSFAYEFKADALFDFFYWFGLSNSVVKVNGKVLNLSSTSPEKKETIKLFLEKMSEPLIRRAVSLTESSV

SEQ ID NO: 754976 - protein, 338 aa, Homo sapiens
ASGSLGGAARAVRLAPERPPRPGQAGRPTPSSPRARLTQAGRPAPPGDHQVPAGGCRHRTEAGGVRTDDAGMAGAACEPVARPSLTSISSGELRSLWTCDCELALLPLAQLLRLQPGAFQLSGDQLVVAGPGEPAAARGGFNVFGDGLVRLDGQLYRLSSYIKRYVELTNYCDYKDYRETILSKPMLFFINVQTKKDTSKERTYAFLVNTRHPKIRRQIEQGMDMVISSVIGESYRLQSMQCSSLFQFDFQEAVKNFFPPGNEVVNGENLSFAYEFKADALFDFFYWFGLSNSVVKVNGKVLNLSSTSPEKKETIKLFLEKMSEPLIRRAVSLTESSV

SEQ ID NO: 754977 - protein, 103 aa, Homo sapiens
HKHTCTHTCTHAQTQNHTHIHTFTQTCTNTCTNTHTHTQTHEKDKSPDACPACLLTPGMQFPDMLAEVLEHIPSHPTIRIHTPRPRETPESADMHHYQGPYRT

SEQ ID NO: 754978 - protein, 272 aa, Homo sapiens
IEYLARVRLSSNLFQRRIFYQGATLKNEINFLLGPVGSYFMFHMNQRFSRRPYLPGQLPPPPLYRPRWVPPSPPPPYDSRLNSPLSLPFVPGRVPPSSFSRFSQAVILSQLFPLESIRQPRLFPGYPNLHFPLRPYYVGPIRILKPPFPPIPFFLAIYLPISNPEPQINITTADTTITTNPPTTATATTSTSTKPTMTISSSTVPISSTPEPATSISAATPAASTENTTQILANRPHTVLLNATVQVTTSNQTILSSPAFKSFWQKLFAIFG

SEQ ID NO: 754979 - protein, 229 aa, Homo sapiens
MNQRFSRRPYLPGQLPPPPLYRPRWVPPSPPPPYDSRLNSPLSLPFVPGRVPPSSFSRFSQAVILSQLFPLESIRQPRLFPGYPNLHFPLRPYYVGPIRILKPPFPPIPFFLAIYLPISNPEPQINITTADTTITTNPPTTATATTSTSTKPTMTISSSTVPISSTPEPATSISAATPAASTENTTQILANRPHTVLLNATVQVTTSNQTILSSPAFKSFWQKLFAIFG

SEQ ID NO: 754980 - protein, 249 aa, Homo sapiens
DIQMNNVSHTIKNTAAFAGCMNQRFSRRPYLPGQLPPPPLYRPRWVPPSPPPPYDSRLNSPLSLPFVPGRVPPSSFSRFSQAVILSQLFPLESIRQPRLFPGYPNLHFPLRPYYVGPIRILKPPFPPIPFFLAIYLPISNPEPQINITTADTTITTNPPTTATATTSTSTKPTMTISSSTVPISSTPEPATSISAATPAASTENTTQILANRPHTVLLNATVQVTTSNQTILSSPAFKSFWQKLFAIFG

SEQ ID NO: 754981 - protein, 229 aa, Homo sapiens; identical to SEQ ID NO: 754979

SEQ ID NO: 754982 - protein, 118 aa, Homo sapiens
MRLANSELRTSHRTEIGGSKMHVGTEYPGRASRRVRGNYTEGRAAASRYRPGTAGGAQAGAGRAAASWSPAGGRASSHRSGIPPRGKKASEGHGGRSAQPQRLGEPGPGPAFGVGGAR

SEQ ID NO: 754983 - protein, 266 aa, Homo sapiens
SPTFSTPQMLRAPAPAPAMAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 754984 - protein, 266 aa, Homo sapiens; identical to SEQ ID NO: 754983

SEQ ID NO: 754985 - protein, 254 aa, Homo sapiens
SPTFSTPQMLRAPAPAPAMAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQVSGTWGLDKMGRRTLGAAGQQ

SEQ ID NO: 754986 - protein, 266 aa, Homo sapiens; identical to SEQ ID NO: 754983

SEQ ID NO: 754987 - protein, 237 aa, Homo sapiens
MVHLIPHFVLAVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 754988 - protein, 31 aa, Homo sapiens
MEKGKLHKPGKDASKRGRQVSGTWGLDKMGR

SEQ ID NO: 754989 - protein, 285 aa, Homo sapiens
MSDDFLWFEGIAFPTMGFRSETLRKVRDEFVIRDEDVIILTYPKSGTNWLAEILCLMHSKGDAKWIQSVPIWERSPWVESEIGYTALSETESPRLFSSHLPIQLFPKSFFSSKAKVIYLMRNPRDVLVSGYFFWKNMKFIKKPKSWEEYFEWFCQGTVLYGSWFDHIHGWMPMREEKNFLLLSYEELKQDTGRTIEKICQFLGKTLEPEELNLILKNSSFQSMKENKMSNYSLLSVDYVVDKAQLLRKGVSGDWKNHFTVAQAEDFDKLFQEKMADLPRELFPWE

SEQ ID NO: 754990 - protein, 285 aa, Homo sapiens; identical to SEQ ID NO: 754989

SEQ ID NO: 754991 - protein, 229 aa, Homo sapiens
MHSKGDAKWIQSVPIWERSPWVESEIGYTALSETESPRLFSSHLPIQLFPKSFFSSKAKVIYLMRNPRDVLVSGYFFWKNMKFIKKPKSWEEYFEWFCQGTVLYGSWFDHIHGWMPMREEKNFLLLSYEELKQDTGRTIEKICQFLGKTLEPEELNLILKNSSFQSMKENKMSNYSLLSVDYVVDKAQLLRKGVSGDWKNHFTVAQAEDFDKLFQEKMADLPRELFPWE

SEQ ID NO: 754992 - protein, 218 aa, Homo sapiens
MSDDFLWFEGIAFPTMGFRSETLRKVRDEFVIRDEDVIILTYPKSGTNWLAEILCLMHSKGDAKWIQSVPIWERSPWVESEIGYTALSETESPRLFSSHLPIQLFPKSFFSSKAKVIYLMRNPRDVLVSGYFFWKNMKFIKKPKSWEEYFEWFCQGTVLYGSWFDHIHGWMPMREEKKEDLSIPGKDVRTRRTELNSQEQLLSEHERKQDVQLFPPEC

SEQ ID NO: 754993 - protein, 285 aa, Homo sapiens; identical to SEQ ID NO: 754989

SEQ ID NO: 754994 - protein, 229 aa, Homo sapiens; identical to SEQ ID NO: 754991

SEQ ID NO: 754995 - protein, 268 aa, Homo sapiens
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPSCQEEEDLALAQALSASEAEYQRQQGPEPQLEAVQLQPVLGPWAWGGRFT

SEQ ID NO: 754996 - protein, 268 aa, Homo sapiens; identical to SEQ ID NO: 754995

SEQ ID NO: 754997 - protein, 289 aa, Homo sapiens
REERAPGAGWRGGSQTLPGLAMEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPSCQEEEDLALAQALSASEAEYQRQQGPEPQLEAVQLQPVLGPWAWGGRFT

SEQ ID NO: 754998 - protein, 282 aa, Homo sapiens
AGWRGGSQTLPGLAMEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPSCQEEEDLALAQALSASEAEYQRQQGPEPQLEAVQLQPVLGPWAWGGRFT

SEQ ID NO: 754999 - protein, 273 aa, Homo sapiens
GGEEFRTSALTVGAICHREGGRENFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPSCQEEEDLALAQALSASEAEYQRQQGPEPQLEAVQLQPVLGPWAWGGRFT

SEQ ID NO: 755000 - protein, 224 aa, Homo sapiens
MEFPDLGAHCSEPSCQRLDFLPLKCDACSGIFCADHVAYAQHHCGSAYQKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPSCQEEEDLALAQALSASEAEYQRQQGPEPQLEAVQLQPVLGPWAWGGRFT

SEQ ID NO: 755001 - protein, 239 aa, Homo sapiens
AGWRGGSQTLPGLAMEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLVSWAEVGWTETNTQRVKSKDAGLLSPFVE

SEQ ID NO: 755002 - protein, 246 aa, Homo sapiens
REERAPGAGWRGGSQTLPGLAMEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLVSWAEVGWTETNTQRVKSKDAGLLSPFVE

SEQ ID NO: 755003 - protein, 224 aa, Homo sapiens
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPRYLTLL

SEQ ID NO: 755004 - protein, 105 aa, Homo sapiens
SSLAGSPVSISMQSHNPISVLDSPSSDCFAEWPGELGRGWMDRNKHTESEVQGRWSSFSLCRVRMKLCSGPWKCPWQKPNPRFQGTLPSCERERKLWARAWSGGR

SEQ ID NO: 755005 - protein, 186 aa, Homo sapiens
SARRALGAAGAGAQTLPGLAMEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVEVALGASGRPC

SEQ ID NO: 755006 - protein, 94 aa, Homo sapiens
TVLVLKLGLLPPDNLEPGVWFLPGTFPGPAAELHPHSGHSAKQSLEGLSRTEMGCGGRPGSLWKALLVLQLHGRERLATVPWLGPQWMLARPYS

SEQ ID NO: 755007 - protein, 224 aa, Homo sapiens; identical to SEQ ID NO: 755003

SEQ ID NO: 755008 - protein, 288 aa, Homo sapiens
SARRALGAAGAGAQTLPGLAMEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPSCQEEEDLALAQALSASEAEYQRQQGPEPQLEAVQLQPVLGPWAWGGRFT

SEQ ID NO: 755009 - protein, 225 aa, Homo sapiens
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLVSWAEVGWTETNTQRVKSKDAGLLSPFVE

SEQ ID NO: 755010 - protein, 196 aa, Homo sapiens
SARRALGAAGAGAQTLPGLAMEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSR

SEQ ID NO: 755011 - protein, 222 aa, Homo sapiens
RTCESRWTCNPTNSLQNFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPRYLTLL

SEQ ID NO: 755012 - protein, 233 aa, Homo sapiens
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPRAQSRSSKPSNCSLC

SEQ ID NO: 755013 - protein, 152 aa, Homo sapiens
SARRALGAAGAGAQTLPGLAMEFPDLGAHCSEPSCQRLDFLPLKCDACSGIFCADHVAYAQHHCGSAYQKIFTNKCERAGCRQREMMKLTCERCSRNFCIKHRHPLDHDCSGEGHPTSRAGLAAISRAQAVASTSTVPSPSQTMPSCTSPSR

SEQ ID NO: 755014 - protein, 139 aa, Homo sapiens
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCINHGPVDAGADAEVVD

SEQ ID NO: 755015 - protein, 124 aa, Homo sapiens
TVTAGHFSIKGKMATLLIVFSMSFYRNCTCTSAQCCSMLALSLNSDWCLAVGRSSCRGSLLWEKGKYVEEERDFNNGRRSLNGTLPPVMKLTLCDFQGKGYNAKTLQAMSNIYWCKCKFILYPY

SEQ ID NO: 755016 - protein, 170 aa, Homo sapiens
LNRTPPSTPDTMTHCCSPCCQPTCCRTTCWKPTTVTTCSSTPCCQPSCCVSSCCQPCCRPTCCQNTCCQPICVTSCCQPSCCSTPCCQPTCCGQTSCGSSCGQSSSCAPVYCRRTCYHPTTVCLPGCLNQSCGSSCCQPCCRPACCETTCCRTTCFQPTCVYSCCQPSCC

SEQ ID NO: 755017 - protein, 147 aa, Homo sapiens
RLSINSSHRSLAGGTRSSATAQISTMKLLTGLVFCSLVLSVSSRSFFSFLGEAFDGARDMWRAYSDMREANYIGSDKYFHARGNYDAAKRGPGGAWAAEVISNARENIQRLTGHGAEDSLADQAANKWGRSGRDPNHFRPAGLPEKY

SEQ ID NO: 755018 - protein, 147 aa, Homo sapiens; identical to SEQ ID NO: 755017

SEQ ID NO: 755019 - protein, 122 aa, Homo sapiens
MKLLTGLVFCSLVLSVSSRSFFSFLGEAFDGARDMWRAYSDMREANYIGSDKYFHARGNYDAAKRGPGGAWAAEVISNARENIQRLTGHGAEDSLADQAANKWGRSGRDPNHFRPAGLPEKY

SEQ ID NO: 755020 - protein, 138 aa, Homo sapiens
RLSINSSHRSLAGGTRSSATAQISTMKLLTGLVFCSLVLSVSSRSFFSFLGEAFDGARDMWRAYSDMREANYIGSDKYFHARGNYDAAKRGPGGAWAAEVIRLKCHGMIMAHCNLDLPGLKRSSHFSLLNNWDCRCAP

SEQ ID NO: 755021 - protein, 108 aa, Homo sapiens
RLSINSSHRSLAGGTRSSATAQISTMKLLTGLVFCSLVLSVSSRSFFSFLGEAFDGARDMWRAYSDMREANYIGSDKYFHARGNYDAAKRGPGGAWAAEVISLFSAEL

SEQ ID NO: 755022 - protein, 247 aa, Homo sapiens
RLSINSSHRSLAGGTRSSATAQISTMKLLTGLVFCSLVLSVSSRSFFSFLGEAFDGARDMWRAYSDMREANYIGSDKYFHARGNYDAAKRGPGGAWAAEVISTMRLFTGIVFCSLVMGVTSESWRSFFKEALQGVGDMGRAYWDIMISNHQNSNRYLYARGNYDAAQRGPGGVWAAKLISRSRVYLQGLIDYYLFGNSSTVSEDSKSNEKAEEWGRSGKEPGRFRTDRLPKKYLSFLVPLVSGNLGL

SEQ ID NO: 755023 - protein, 71 aa, Homo sapiens
HSPLRWCWSLYVLLMSLLPFLSFPGARDMWRAYSDMREANYIGSDKYFHARGNYDAAKRGPGGAWAAEVIR

SEQ ID NO: 755024 - protein, 862 aa, Homo sapiens
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRYVQEVMRRGRACVRPACAPVLHVVPAVSDMELSETETRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 755025 - protein, 845 aa, Homo sapiens
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRTRSQRKVGGGSAQPCDSIVVAYYFCGEPIPYRTLVRGRAVTLGQFKELLTKKGSYRPPSHLRCCLLTALLTSVCRYYFKKVSDEFDCGVVFEEVREDEAVLPVFEEKIIGKVEKVD

SEQ ID NO: 755026 - protein, 790 aa, Homo sapiens
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRTRSQRKVGGGSAQPCDSIVVAYYFCGEPIPYRTLVRGRAVTLGQFKELPPAAGCAVLGPPF

SEQ ID NO: 755027 - protein, 719 aa, Homo sapiens
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLMIAAGILRVTVN

SEQ ID NO: 755028 - protein, 826 aa, Homo sapiens
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRTRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 755029 - protein, 640 aa, Homo sapiens
MYRDRGMLGRGTRPLTCTLSCISLRLLLTDPVWGDPIQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRTRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 755030 - protein, 458 aa, Homo sapiens
ILQDLVTFDDVAWYLTTREWFKLDPEQRALEYYGNVTSVGVPVLNPALVPHLAQGQVLLVSDPSPNTDPAKYSESTSATRHQMKGEDAQPQEMASTSFPRASGPSPEFRQHGDSDGKRGSPQNLPIEHHFACKECWGYLRLKVLLVQHQRVHSEEKGWECGDCGKVFRGVAEFNEHRKSHVAAEPQPGPSRALENAAEKREQMEREAKPFECEECGKRFKKNAGLSQHLRVHSREKPFDCEECGRSFKVNTHLFRHQKLHTSEKPFACKACSRDFLDRQELLKHQRMHTGHLPFDCDDCGKSFRGVNGLAEHQRIHSGAKPYGCPHCGKLFRRSSELTKHRRIHTGEKPYACGQCGKAFRQSSSLLEHARIHSGERPYACGECGKAFRGPSDLIKHRRIHSGLKPYECDKCGKAFRRSSGLSRHRRIHSGARRCECSQCGRVFKRRSALQKHQPTHHE

SEQ ID NO: 755031 - protein, 256 aa, Homo sapiens
MEREAKPFECEECGKRFKKNAGLSQHLRVHSREKPFDCEECGRSFKVNTHLFRHQKLHTSEKPFACKACSRDFLDRQELLKHQRMHTGHLPFDCDDCGKSFRGVNGLAEHQRIHSGAKPYGCPHCGKLFRRSSELTKHRRIHTGEKPYACGQCGKAFRQSSSLLEHARIHSGERPYACGECGKAFRGPSDLIKHRRIHSGLKPYECDKCGKAFRRSSGLSRHRRIHSGARRCECSQCGRVFKRRSALQKHQPTHHE

SEQ ID NO: 755032 - protein, 69 aa, Homo sapiens
SRAGQLAGRFGCCAGDMGGKSHEDTYMAAFNSTRIREDNIKKVNYRCLPISRKDAKVILTQRSNDVATS

SEQ ID NO: 755033 - protein, 190 aa, Homo sapiens
WDGWARTPRMEPMEALNTAQALRDFIYSLHSTERSCLLKELHRFESIAIAQEKLEAPPPTPGQLRYVFIHNAIPFIGFGFLDNAIMIVAGTHIEMSIGIILGISTMAAAALGNLVSDLAGLGLAGYVEALASRLGLSIPDLTPKQVDMWQTRLSTHLGKAVGVTIGCILGMFPLIFFGGGEEDEKLETKS

SEQ ID NO: 755034 - protein, 190 aa, Homo sapiens; identical to SEQ ID NO: 755033

SEQ ID NO: 755035 - protein, 299 aa, Homo sapiens
PGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKVLF

SEQ ID NO: 755036 - protein, 336 aa, Homo sapiens
PGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPN

SEQ ID NO: 755037 - protein, 188 aa, Homo sapiens
ILVLFQAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPN

SEQ ID NO: 755038 - protein, 164 aa, Homo sapiens
PGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEVFVKHGVGLK

SEQ ID NO: 755039 - protein, 117 aa, Homo sapiens
MLRYNQVNCKVIYTCIKVQLRKDCLDCVYLALRRRESQGQSSHSQELYLVGFMKGFLVTQSRYIISKMWSAVQMSAHARDWLGASYQFFHPVPGSYLLPLGLAQPRVWLRLPRVWPL

SEQ ID NO: 755040 - protein, 381 aa, Homo sapiens
MREKVPLASQYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 755041 - protein, 279 aa, Homo sapiens
MIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFLTARRRIVPAYDRTIPPTTAVAAFAQKGRPTGVPNGTHWPRARERRTRPDGQGTHSAAGPPVGQKRLAGPKPRPETTREGHHTTLTGDPAKYTPIKTQ

SEQ ID NO: 755042 - protein, 91 aa, Homo sapiens
RPVRHEKIWHHTFYNELRVPRRSTHVLLTEAPLNPKATQMDIEPNSPRYCPANSDITTLGPGLTTVPSCTHVTLATSQSGCSRDHTHTPLT

SEQ ID NO: 755043 - protein, 375 aa, Homo sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 755044 - protein, 358 aa, Homo sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 755045 - protein, 444 aa, Homo sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSAGAGRHVIAPSLRLPWSPSWGAQRRSEAPVLPDVCLGLGSPSPGPRWARPWGSDCGRPGRQSDSCWWLQHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 755046 - protein, 375 aa, Homo sapiens; identical to SEQ ID NO: 755043

SEQ ID NO: 755047 - protein, 411 aa, Homo sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFLTARRRIVPAYDRTIPPTTAVAAFAQKGRPTGVPNGTHWPRARERRTRPDGQGTHSAAGPPVGQKRLAGPKPRPETTREGHHTTLTGDPAKYTPIKTQ

SEQ ID NO: 755048 - protein, 333 aa, Homo sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQVGPGRAPGIVLQPQLCLDIRMRAHVHYTASDEATVSLITGHAYAHSHTPTTQQLRRLGCGWATVHRHTHTSGCRCHPQIQLHPHRSTYSHTNSATAISAHSQTVASTGYSHTPPSPAIRQQHRTHSRVPHAVLN

SEQ ID NO: 755049 - protein, 108 aa, Homo sapiens
PLYPPLSALPHPQSLSSVPGLPPPSQPPAPHRPPFFLLSSVLPFALLLFQAAPASPGLGVGQGWERWSHQAAGPTEPVSLGMGTGIEDRGGGARPFWGFRVGCEDRFW

SEQ ID NO: 755050 - protein, 104 aa, Homo sapiens
GWGQELAEGGWREKRALERALRGLALALSLWSGGLATAACKKGGESRAGGFVSGRGSADTAQNGGGKGVSAQLAWVERTAIGWRRLERAASPSLRLSQRPPLVP

SEQ ID NO: 755051 - protein, 402 aa, Homo sapiens
MGVSKLDILYRRLLLTKLFIRGWGRPEDLKRLFEFRKMIGNRERCQNLVSSDYPVHIDKIEEQSDCKILDGHFVSPMAHYVPDIMPIESVIARFQFIVPKEWNSKYRPVCIHLAGTGDHHYWRRRTLMARPMIKEARMASLLLENPYYGLQETQGPSMASLAVSNWPKPMPLIPCLSWSTASGVFTTGVLSKSINWRELEKQYYTQTVYEEEIIHMLEYCGTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFR

SEQ ID NO: 755052 - protein, 135 aa, Homo sapiens
MGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSGTNFYMKLRIFADV

SEQ ID NO: 755053 - protein, 444 aa, Homo sapiens
MGVSKLDILYRRLLLTKLFIRGWGRPEDLKRLFEFRKMIGNRERCQNLVSSDYPVHIDKIMDEMLDTNLILLPWFQFIVPKEWNSKYRPVCIHLAGTGDHHYWRRRTLMARPMIKEARMASLLLENPYYGAETQDSRRSSLKNVSDLFVMGGALVLESAALLHWLEREGYGPLGMTGISMGGHMASLAVSNWPKPMPLIPCLSWSTASGVFTTGVLSKSINWRELEKQYYTQTVYEEEIIHMLEYCGTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFRQAIYDAFDRFLHKYAN

SEQ ID NO: 755054 - protein, 337 aa, Homo sapiens
MARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTGVLSKSINWRELEKQYYTQTVYEEEIIHMLEYCGTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFRQAIYDAFDRFLHKYAN

SEQ ID NO: 755055 - protein, 280 aa, Homo sapiens [sequence omitted]

SEQ ID NO: 755056 - protein, 147 aa, Homo sapiens
GGVTRKAGQRRAKGGCVLSLLPRHAPPILTGTESPGELGACPNCRAALLRVCLPPSVSPSAVSSISVPGKVTGAAIGAGTKVESWKGSLESGGAGRPGQLDRRLPPGGQCLFATDGCEQVRYSIPETSPNKTFYQRMGKARRSQKTL

SEQ ID NO: 755057 - protein, 337 aa, Homo sapiens; identical to SEQ ID NO: 755054

SEQ ID NO: 755058 - protein, 321 aa, Homo sapiens
MARPMIKEARMASLLLENPYYGCRKPKDQVRSSLKNVSDLFVMGGALVLESAALLHWLEREGYGPLGMTGISMGGHMASLAVSNWPKPMPLIPCLSWSTASGVFTTGVLSKSINWRELEKQYYTQTVYEEEIIHMLEYCGTDSFKMGQEFVKHFTSSADKLTNLNLVSRTLNLDISNQVVSQKPADCHNSSKTSVSATSEGLLLQDTSKMKRFNQTLSTNKSGYTSRNPQSYHLLSKEQSRNSLRKESLIFMKGVMDECTHVANFSVPVDPSLIIVVQAKEDAYIPRTGVRSLQEIWPGCEIRYLEGGHISAYLFKQGLFR

SEQ ID NO: 755059 - protein, 322 aa, Homo sapiens
MGVSKLDILYRRLLLTKLFIRGWGRPEDLKRLFEFRKMIGNRERCQNLVSSDYPVHIDKIEEQSDCKILDGHFVSPMAHYVPDIMPIESVIARFQFIVPKEWNSKYRPVCIHLAGTGDHHYWRRRTLMARPMIKEARMASLLLENPYYGCRKPKDQVVSPVGQAGLELPTSGDPPASAPQSAGITGSIHRAQLKNFHFGTKPRIQKRSSLKNVSDLFVMGGALVLESAALLHWLEREGYGPLGMTGISMGGHMASLAVSNWPKPMPLIPCLSWSTASGVFTTGVLSKSINWRELEKQYYTQTVYEEEIIHMLEYCGVSISLS

SEQ ID NO: 755060 - protein, 105 aa, Homo sapiens
SSLGRRSEMMKGTSSFGKHCNKTYTLCHHCGSKAYHLQKSTYGKCGYTAKRKRKYNWSTKAKRRNTTRTGQMRHLKIVYHRFRHGFREGTTPKPKRAAVAASSSS

SEQ ID NO: 755061 - protein, 117 aa, Homo sapiens
MEFSSPSREECPKPSGRVSIMAGSSQDCFYFRQCRGHQMSAFSRYKSRSSGHWMELSTGPYRLIAPAQESDITSSGYPWASCDFFHPHLTPMADTPDDFPVCTISASQRKIPSSRYP

SEQ ID NO: 755062 - protein, 116 aa, Homo sapiens
EDLFFEAYFSSCFVPLFIWVEHVRELLSCVPVLLSPGSLCQWAVAFKGLTAGLEAPIPALFPPASSSGFLLPLQSWKGSLISWLFLLMILVCLLPVQHQHGLLGLPVSLPLAFCLG

SEQ ID NO: 755063 - protein, 113 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLWSKERFYCLRLHSYLYYIKFS

SEQ ID NO: 755064 - protein, 464 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 755065 - protein, 464 aa, Homo sapiens; identical to SEQ ID NO: 755064

SEQ ID NO: 755066 - protein, 464 aa, Homo sapiens; identical to SEQ ID NO: 755064

SEQ ID NO: 755067 - protein, 464 aa, Homo sapiens; identical to SEQ ID NO: 755064

SEQ ID NO: 755068 - protein, 326 aa, Homo sapiens
MEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 755069 - protein, 207 aa, Homo sapiens [sequence omitted]

SEQ ID NO: 755070 - protein, 328 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARQEVVEKYEIYGDSVDCLPSCQLEVQLYQKKIQDLSDNREKLASILKEVCIVWNFDVFII

SEQ ID NO: 755071 - protein, 124 aa, Homo sapiens
VQWHNHIPLQLLNLLGTSDSPTSFLSSWDYRSVNHLAELIFFFFLAVVMASHFVAQAGLKLLASNNLLACASQSSLDYRCEPLHLAFSFSSLLLVLHIPAALISLNSVLYFPSLSILSLYTFFP

SEQ ID NO: 755072 - protein, 93 aa, Homo sapiens
GRGSPLRPQPAQRGAPTVQLRAEGLLKRGQSGLRPRRRREPARGCQQAVTSQKYRKNINNVRSYKLRRPEVRKQGVCRTNLSSGCSRRSQLPC

SEQ ID NO: 755073 - protein, 93 aa, Homo sapiens; identical to SEQ ID NO: 755072

SEQ ID NO: 755074 - protein, 109 aa, Homo sapiens
TTHTNPLLDFGFRKHRCDPGLLKRQLHSPGNTPLSQTWLKTRSSLASSGRMDLLTFINSSHCQGQQHLRYSFLGVPAFLPPGGYFLSWASWPLSSLLHIAVLRAFAAAT

SEQ ID NO: 755075 - protein, 414 aa, Homo sapiens [sequence omitted]

SEQ ID NO: 755076 - protein, 414 aa, Homo sapiens [sequence omitted]

SEQ ID NO: 755077 - protein, 414 aa, Homo sapiens [sequence omitted]

SEQ ID NO: 755078 - protein, 414 aa, Homo sapiens [sequence omitted]

SEQ ID NO: 755079 - protein, 122 aa, Homo sapiens
HKAGRGRVVNRHRGFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 755080 - protein, 146 aa, Homo sapiens
MLGPEGGEGFVVKLRGLPWSCSVEDVQNFLSDCTIHDGAAGVHFIYTREGRQSGEAFVELGSEDDVKMALKKDRESMGHRYIEVFKSHRTEMDWVLKHSGPNSADSANDGFVRLRGLPFGCTKAWPRFLGGKGAPGYMAVGPSKYS

SEQ ID NO: 755081 - protein, 128 aa, Homo sapiens
PAAPLAPPPARKLPPEPAQALGPTFLPGRAVRGCWSAVSRPRERRRHLVSGPRRCFPPKHVYRAPGPPTLRKGPHHHLDFCCRLRTKTCTWSFPGALCVVELRWNFGALGCQPRLPGSNRNQSCSPPW

SEQ ID NO: 755082 - protein, 414 aa, Homo sapiens [sequence omitted]

SEQ ID NO: 755083 - protein, 414 aa, Homo sapiens [sequence omitted]

SEQ ID NO: 755084 - protein, 414 aa, Homo sapiens [sequence omitted]

SEQ ID NO: 755085 - protein, 414 aa, Homo sapiens [sequence omitted]

SEQ ID NO: 755086 - protein, 414 aa, Homo sapiens [sequence omitted]

SEQ ID NO: 755087 - protein, 414 aa, Homo sapiens [sequence omitted]

SEQ ID NO: 755088 - protein, 414 aa, Homo sapiens [sequence omitted]

SEQ ID NO: 755089 - protein, 414 aa, Homo sapiens [sequence omitted]

SEQ ID NO: 755090 - protein, 414 aa, Homo sapiens [sequence omitted]

SEQ ID NO: 755091 - protein, 414 aa, Homo sapiens [sequence omitted]

SEQ ID NO: 755092 - protein, 414 aa, Homo sapiens [sequence omitted]

SEQ ID NO: 755093 - protein, 414 aa, Homo sapiens [sequence omitted]

SEQ ID NO: 755094 - protein, 414 aa, Homo sapiens [sequence omitted]

SEQ ID NO: 755095 - protein, 414 aa, Homo sapiens [sequence omitted]

SEQ ID NO: 755096 - protein, 414 aa, Homo sapiens [sequence omitted]

SEQ ID NO: 755097 - protein, 415 aa, Homo sapiens
MMLGPEGGEGFVVKLRGLPWSCSVEDVQNFLSDCTIHDGAAGVHFIYTREGRQSGEAFVELGSEDDVKMALKKDRESMGHRYIEVFKSHRTEMDWVLKHSGPNSADSANDGFVRLRGLPFGCTKEEIVQFFSGLEIVPNGITLPVDPEGKITGEAFVQFASQELAEKALGKHKERIGHRYIEVFKSSQEEVRSYSDPPLKFMSVQRPGPYDRPGTARRYIGIVKQAGLERMRPGAYSTGYGGYEEYSGLSDGYGFTTDLFGRDLSYCLSGMYDHRYGDSEFTVQSTTGHCVHMRGLPYKATENDIYNFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 755098 - protein, 347 aa, Homo sapiens
MALKKDRESMGHRYIEVFKSHRTEMDWVLKHSGPNSADSANDGFVRLRGLPFGCTKEEIVQFFSGLEIVPNGITLPVDPEGKITGEAFVQFASQELAEKALGKHKERIGHRYIEVFKSSQEEVRSYSDPPLKFMSVQRPGPYDRPGTARRYIGIVKQAGLERMRPGAYSTGYGGYEEYSGLSDGYGFTTDLFGRDLSYCLSGMYDHRYGDSEFTVQSTTGHCVHMRGLPYKATENDIYNFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 755099 - protein, 414 aa, Homo sapiens [sequence omitted]

SEQ ID NO: 755100 - protein, 414 aa, Homo sapiens [sequence omitted]

SEQ ID NO: 755101 - protein, 414 aa, Homo sapiens [sequence omitted]

SEQ ID NO: 755102 - protein, 414 aa, Homo sapiens [sequence omitted]

SEQ ID NO: 755103 - protein, 414 aa, Homo sapiens [sequence omitted]

SEQ ID NO: 755104 - protein, 278 aa, Homo sapiens
WLVGGGIGRPEGKITGEAFVQFASQELAEKALGKHKERIGHRYIEVFKSSQEEVRSYSDPPLKFMSVQRPGPYDRPGTARRYIGIVKQAGLERMRPGAYSTGYGGYEEYSGLSDGYGFTTDLFGRDLSYCLSGMYDHRYGDSEFTVQSTTGHCVHMRGLPYKATENDIYNFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 755105 - protein, 214 aa, Homo sapiens [sequence omitted]

SEQ ID NO: 755106 - protein, 97 aa, Homo sapiens
RDPRPAAGLGSRGLRFPDSGPRASSGPTGQSLAWLRTKTCTWSFPGALCVVELRWNFGALGCQPRLPGSNRNQSCSPPWTFHYHPEVSPTEGIRGCF

SEQ ID NO: 755107 - protein, 179 aa, Homo sapiens
MLGPEGGEGFVVKLRGLPWSCSVEDVQNFLSDCTIHDGAAGVHFIYTREGRQSGEAFVELGSEDDVKMALKKDRESMGHRYIEVFKSHRTEMDWVLKHSGPNSADSANDGFVRLRGLPFGCTKEEIVQFFSGLEIVPNGITLPVDPEGKITGEAFVQFASQELAEKALGKHKEFFQVPG

SEQ ID NO: 755108 - protein, 77 aa, Homo sapiens
IACDTEKIKSDITLLLNDSISIHYAIEILLLGGRNSMFDVVSHSSHQSELAVRKCSQGVVKGASSLIQRNISHVCSF

SEQ ID NO: 755109 - protein, 75 aa, Homo sapiens
MLGPEGGEGFVVKLRGLPWSCSVEDVQNFLSDCTIHDGAAGVHFIYTREGRQSGEAFVELGFSDETVERGVTEAR

SEQ ID NO: 755110 - protein, 40 aa, Homo sapiens
MEHQSLLPFSRNQARRSSVNELPPRIPETGFHRAPQGKHW

SEQ ID NO: 755111 - protein, 234 aa, Homo sapiens
KRIHTGEKPYTCEECGKAFNQSSTLILHKRIHSGQKPYKCEECGKAFTRSTTLNEHKKIHTGEKPYKCEECGKAFIWSASLNEHKNIHTGEKPYKCKECGKAFNQSSGLIIHRSIHSEQKLYKCEECGKAFTRSTALNEHKKIHSGEKPYKCKECGKAYNLSSTLTKHKRIHTGEKPFTCEECGKAFNWSSSLTKHKIIHTGEKSYKCEECGKAFNRPSTLTVHKRIHTGKEHS

SEQ ID NO: 755112 - protein, 54 aa, Homo sapiens
SWNTGWRQQGRVSLARLTLRRWGAAEGRESRRDRWSDLDLRNDITHARSGMEVA

SEQ ID NO: 755113 - protein, 149 aa, Homo sapiens
MPNGIGCHVLPLLVYVSRSSVLISPLCRPAPSWGWILQERGKQPSKASFLLFHLQDPGLGTFGATGWKYSPLPHPPHPSSEALGRGLEPVVRSFPSKPCRGQPLNGPKIPWTQGIPCGIPSRAAEAGKLNHISQTLLQLVFLMAWKSCH

SEQ ID NO: 755114 - protein, 470 aa, Homo sapiens
MAGENHQWQGSILYNMLMSAKQTRAAPEAPETRLVDQCWGCSCGDEPGVGREGLLGGRNVALLYRCCFCGKDHPRQGSILYSMLTSAKQTYAAPKAPEATLGPCWGCSCGSDPGVGRAGLPGGRPVALLYRCCFCGEDHPRQGSILYSLLTSSKQTHVAPAAPEARPGGAWWDRSYFAQRPGGKEALPGGRATALLYRCCFCGEDHPQQGSTLYCVPTSTNQAQAAPEERPRAPWWDTSSGALRPVALKSPQVVCEAASAGLLKTLRFVKYLPCFQVLPLDQQLVLVRNCWASLLMLELAQDRLQFETVEVSEPSMLQKILTTRRRETGGNEPLPVPTLQHHLAPPAEARKVPSASQVQAIKCFLSKCWSLNISTKEYAYLKGTVLFNPDVPGLQCVKYIQGLQWGTQQILSEHTRMTHQGPHDRFIELNSTLFLLRFINANVIAELFFRPIIGTVSMDDMMLEMLCTKI

SEQ ID NO: 755115 - protein, 470 aa, Homo sapiens; identical to SEQ ID NO: 755114

SEQ ID NO: 755116 - protein, 228 aa, Homo sapiens
MLHVEMLTLVFLVLWMCVFSQDPGSKAVADRYAVYWNSSNPRFQRGDYHIDVCINDYLDVFCPHYEDSVPEDKTERYVLYMVNFDGYSACDHTSKGFKRWECNRPHSPNGPLKFSEKFQLFTPFSLGFEFRPGREYFYISSAIPDNGRRSCLKLKVFVRPTNSCMKTIGVHDRVFDVNDKVENSLEPADDTVHESAEPSRGENAAQTPRIPSRLLAILLFLLAMLLTL

SEQ ID NO: 755117 - protein, 148 aa, Homo sapiens
MVNFDGYSACDHTSKGFKRWECNRPHSPNGPLKFSEKFQLFTPFSLGFEFRPGREYFYISSAIPDNGRRSCLKLKVFVRPTNSCMKTIGVHDRVFDVNDKVENSLEPADDTVHESAEPSRGENAAQTPRIPSRLLAILLFLLAMLLTL

SEQ ID NO: 755118 - protein, 228 aa, Homo sapiens; identical to SEQ ID NO: 755116

SEQ ID NO: 755119 - protein, 175 aa, Homo sapiens
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQRKLQNK

SEQ ID NO: 755120 - protein, 454 aa, Homo sapiens
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKAGVSISVVHGNLSEEAAKQMRSRGKVLKTKDGKLPFCAMGVSSVIHPKNPHAPTIHFNYRYFEVEEADGNKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCDDSFTPQEKLWQQLRRGRYVEFNLLYDRGTKFGLFTPGSRIESILMSLPLTARWEYMHSPSENSKEAEILEVLRHPRDWVR

SEQ ID NO: 755121 - protein, 436 aa, Homo sapiens
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKAGVSISVVHGNLSEEAAKQMRSRGSVIHPKNPHAPTIHFNYRYFEVEEADGNKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCDDSFTPQEKLWQQLRRGRYVEFNLLYDRGTKFGLFTPGSRIESILMSLPLTARWEYMHSPSENSKEAEILEVLRHPRDWVR

SEQ ID NO: 755122 - protein, 249 aa, Homo sapiens
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKCWDYRHEPPRLAAFTSFFLPRPYWSSELKSVKIFFIVIHFMLKKLSC

SEQ ID NO: 755123 - protein, 249 aa, Homo sapiens; identical to SEQ ID NO: 755122

SEQ ID NO: 755124 - protein, 454 aa, Homo sapiens; identical to SEQ ID NO: 755120

SEQ ID NO: 755125 - protein, 374 aa, Homo sapiens
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKAGVSISVVHGNLSEEAAKQMRSRGKVLKTKDGKLPFCAMGVSSVIHPKNPHAPTIHFNYRYFEVEEADGNKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCM

SEQ ID NO: 755126 - protein, 324 aa, Homo sapiens
MAPPVTDLGELRRRPGDMKTKMELLILETQAQVCQALAQVDGGANFSVDRWERKEGGGGISCVLQDGCVFEKAGVSISVVHGNLSEEAAKQMRSRGKVLKTKDGKLPFCAMGVSSVIHPKNPHAPTIHFNYRYFEVEEADGNKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCDDSFTPQEKLWQQLRRGRYVEFNLLYDRGTKFGLFTPGSRIESILMSLPLTARWEYMHSPSENSKEAEILEVLRHPRDWVR

SEQ ID NO: 755127 - protein, 297 aa, Homo sapiens
MSPDGIRPGVVLNRAAKKCEFSVGSGWRPPPSRASGGGARGPAGPRGGLVSKSSPKKPRGRNIFKALFCCFRAQHVGQSSSSTELAAYKEEANTIAKSDLLQCLQYQFYQIPGTCLLPEVTEEDQGRICVVIDLDETLVHSSFKPINNADFIVPIEIEGTTHQVYVLKRPYVDEFLRRMGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELSGAEDVYTSLGQLRAP

SEQ ID NO: 755128 - protein, 271 aa, Homo sapiens
MEHGSIITQARREDALVLTKQGLVSKSSPKKPRGRNIFKALFCCFRAQHVGQSSSSTELAAYKEEANTIAKSDLLQCLQYQFYQIPGTCLLPEVTEEDQGRICVVIDLDETLVHSSFKPINNADFIVPIEIEGTTHQVYVLKRPYVDEFLRRMGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELSGAEDVYTSLGQLRAP

SEQ ID NO: 755129 - protein, 290 aa, Homo sapiens [sequence omitted]

SEQ ID NO: 755130 - protein, 388 aa, Homo sapiens [sequence omitted]

SEQ ID NO: 755131 - protein, 376 aa, Homo sapiens [sequence omitted]

SEQ ID NO: 755132 - protein, 321 aa, Homo sapiens [sequence omitted]

SEQ ID NO: 755133 - protein, 298 aa, Homo sapiens [sequence omitted]

SEQ ID NO: 755134 - protein, 286 aa, Homo sapiens [sequence omitted]

SEQ ID NO: 755135 - protein, 231 aa, Homo sapiens [sequence omitted]

SEQ ID NO: 755136 - protein, 199 aa, Homo sapiens
MLLLFLLFEGLCCPGENTAVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 755137 - protein, 144 aa, Homo sapiens
MLLLFLLFEGLCCPGENTAVKPEAWLSCGPSPGPGRLQLVCHVSGFYPKPVWVMWMRGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 755138 - protein, 378 aa, Homo sapiens
MLLLFLLFEGLCCPGENTAAAEEQLSFRMLQTSSFANHSWAHSEGSGWLGDLQTHGWDTVLGTIRFLKPWSHGNFSKQELKNLQSLFQLYFHSFIRIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 755139 - protein, 333 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIRIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWALSFSWEPTLRTPRIQDISSAWHKYRGSKTEY

SEQ ID NO: 755140 - protein, 342 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIRIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGEKQLRLCWEIMKIALGLLSVGLRKWVGMLGTRRVKLGQSK

SEQ ID NO: 755141 - protein, 125 aa, Homo sapiens [sequence omitted]

SEQ ID NO: 755142 - protein, 187 aa, Homo sapiens
MLLLFLLFEGLCCPGENTAVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 755143 - protein, 132 aa, Homo sapiens
MLLLFLLFEGLCCPGENTAVKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 755144 - protein, 342 aa, Homo sapiens; identical to SEQ ID NO: 755140

SEQ ID NO: 755145 - protein, 191 aa, Homo sapiens
MLLLFLLFEGLCCPGENTADPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWWIFHLSHPDLFDCDSYPGHIGCS

SEQ ID NO: 755146 - protein, 327 aa, Homo sapiens
MAAIYLSRGFFSREPICPFEEKTKVERMVEDYLASGYQDSVTFDDVAVDFTPEEWALLDTTEKYLYRDVMLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTTVGKPSLDQLNLLNM

SEQ ID NO: 755147 - protein, 332 aa, Homo sapiens
MAAIYLSRGFFSREPICPFEEKTKVERMVEDYLASGYQDSVTFDDVAVDFTPEEWALLDTTEKYLYRDVMLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTYCGKAFTRSTQLTEHVKNSH

SEQ ID NO: 755148 - protein, 290 aa, Homo sapiens
HSSGERYFSVVSSKAHSSGVKSTTEKYLYRDVMLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTTVGKPSLDQLNLLNM

SEQ ID NO: 755149 - protein, 300 aa, Homo sapiens
MPVIPATQETEDSVTFDDVAVDFTPEEWALLDTTEKYLYRDVMLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTTVGKPSLDQLNLLNM

SEQ ID NO: 755150 - protein, 709 aa, Homo sapiens
MPLTLLQDWCRGEHLNTRRCMLILGIPEDCGEDEFEETLQEACRHLGRYRVIGRMFRREENAQAILLELAQDIDYALLPREIPGKGGPWEVIVKPRNSDGEFLNRLNRFLEEERRTVSDMNRVLGSDTNCSAPRVTISPEFWTWAQTLGAAVQPLLEQMLYRELRVFSGNTISIPGALAFDAWLEHTTEMLQMWQVPEGEKRRRLMECLRGPALQVVSGLRASNASITVEECLAALQQVFGPVESHKIAQVKLCKAYQEAGEKVSSFVLRLEPLLQRAVENNVVSRRNVNQTRLKRVLSGATLPDKLRDKLKLMKQRRKPPGFLALVKLLREEEEWEATLGPDRESLEGLEVAPRPPARITGVGAVPLPASGNSFDARPSQGYRRRRGRGQHRRGGVARAGSRGSRKRKRHTFCYSCGEDGHIRVQCINPSNLLLVKQKKQAAVESGNGNWAWDKSHPKSKAKYGSGEQGNISYHRPRRQKRYWKEGKEKPRQTADELSGAEGQGSQTKAKPSHPWPAGRDFSNQDHLATGSVGVRSRSPKRCWRGKQGATASSTWGAWASDGDPKEAEAEEGTAGGSVLLIQPPLNTHPVDFELNMPTGPQATWDLEEPTWGLPLPAGARAGEEELGGRGKALQGRPQGPSRLQDHLHCTRGAPGRQHPGGPVPVRTGDPKAPGAQCQPEVVQARRPKIDEKTPSRGTGYPAGQCPHS

SEQ ID NO: 755151 - protein, 463 aa, Homo sapiens
MPLTLLQDWCRGEHLNTRRCMLILGIPEDCGEDEFEETLQEACRHLGRYRVIGRMFRREENAQAILLELAQDIDYALLPREIPGKGGPWEVIVKPRNSDGEFLNRLNRFLEEERRTVSDMNRVLGSDTNCSAPRVTISPEFWTWAQTLGAAVQPLLEQMLYRELRVFSGNTISIPGALAFDAWLEHTTEMLQMWQVPEGEKRRRLMECLRGPALQVVSGLRASNASITVEECLAALQQVFGPVESHKIAQVKLCKAYQEAGEKVSSFVLRLEPLLQRAVENNVVSRRNVNQTRLKRVLSGATLPDKLRDKLKLMKQRRKPPGFLALVKLLREEEEWEATLGPDRESLEGLEVAPRPPARITGVGAVPLPASGNSFDARPSQGYRRRRGRGQHRRGGVARAGSRGSRKRKRHTFCYSCGEDGHIRVQCINPSNLLLVKQKKQAAVESGNGNWAWDKSHPKSKAK

SEQ ID NO: 755152 - protein, 92 aa, Homo sapiens
MPLTLLQDWCRGEHLNTRRCMLILGIPEDCGEDEFEETLQEACRHLGRYRVIGRMFRREENAQAILLELAQDIDYALLPREIPGKGGPWEVI

SEQ ID NO: 755153 - protein, 668 aa, Homo sapiens
MPLTLLQDWCRGEHLNTRRCMLILGIPEDCGEDEFEETLQEACRHLGRYRVIGRMFRREENAQAILLELAQDIDYALLPREIPGKGGPWEVIVKPRNSDGEFLNRLNRFLEEERRTVSDMNRVLGSDTNCSAPRVTISPEFWTWAQTLGAAVQPLLEQMLYRELRVFSGNTISIPGALAFDAWLEHTTEMLQMWQVPEGEKRRRLMECLRGPALQVVSGLRASNASITVEECLAALQQVFGPVESHKIAQVKLCKAYQEAGEKVSSFVLRLEPLLQRAVENNVVSRRNVNQTRLKRVLSGATLPDKLRDKLKLMKQRRKPPGFLALVKLLREEEEWEATLGPDRESLEGLEVAPRPPARITGVGAVPLPASGNSFDARPSQGYRRRRGRGQHRRGGVARAGSRGSRKRKRHTFCYSCGEDGHIRVQCINPSNLLLPRRQKRYWKEGKEKPRQTADELSGAEGQGSQTKAKPSHPWPAGRDFSNQDHLATGSVGVRSRSPKRCWRGKQGATASSTWGAWASDGDPKEAEAEEGTAGGSVLLIQPPLNTHPVDFELNMPTGPQATWDLEEPTWGLPLPAGARAGEEELGGRGKALQGRPQGPSRLQDHLHCTRGAPGRQHPGGPVPVRTGDPKAPGAQCQPEVVQARRPKIDEKTPSRGTGYPAGQCPHS

SEQ ID NO: 755154 - protein, 709 aa, Homo sapiens; identical to SEQ ID NO: 755150

SEQ ID NO: 755155 - protein, 117 aa, Homo sapiens
MESRDASIHTSCRAAQAPTPPRAPGCTAIKNNEGLRGWPAYVADSIILTLLLPSGLLVPPPRSPFSSQRPKACGVMSHSGCSRWEMCACLPASYPGFTLRTWTTVSGDVCSGHIMQI

SEQ ID NO: 755156 - protein, 104 aa, Homo sapiens
WSLALSPRLECSDAISAHCNLCLPGSSDSSASASRVPGTTGTRHNAWLIFIFLVEMGFCHVGQDGLELLTSSDPPTSASQNAGITSASHPARPKRSQTFISYKI

SEQ ID NO: 755157 - protein, 62 aa, Homo sapiens
LTSIFKAAKPRNRSPNGESSSPDSGYLSPKNQPSALLSASASQSPMEDQGEMEREVKSPGAR

SEQ ID NO: 755158 - protein, 956 aa, Homo sapiens [sequence omitted]

SEQ ID NO: 755159 - protein, 234 aa, Homo sapiens
MEAKAAILDDPMECSRGERLSITLAKNRINRAPERLGKAKVEVDIFELLRDSEYETAETMCQILPKGVVAVLGPSSSPASSSIISNICGEKEVPHFKVAPEEFVKFQFQRFTTLNLHPSNTDISVAVAGILNFFNCTTACLICAKAECLLNLEKLLRQFLISKDTLSVRMLDDTRDPTPLLKEIRDDKTATIIIHANASMSHTILLKAAELGMVSAYYTYIFTNLEFTGQRGSI

SEQ ID NO: 755160 - protein, 2415 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACPGTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAETEESTEGPSATEVPSASEEPSPSEVPFPSEEPSPSEEPFPSVRPFPSVELFPSEEPFPSKEPSPSEEPSASEEPYTPSPPEPSWTELPSSGEESGAPDVSGDFTGSGDVSGHLDFSGQLSGDRASGLPSGDLDSSGLTSTVGSGLTVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDVSGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 755161 - protein, 967 aa, Homo sapiens
GTSPNPEAEISRTSSPEGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDVSGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 755162 - protein, 2239 aa, Homo sapiens
MAQGEQSGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACPGTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAETEESTEGPSATEVPSASEEPSPSEVPFPSEEPSPSEEPFPSVRPFPSVELFPSEEPFPSKEPSPSEEPSASEEPYTPSPPEPSWTELPSSGEESGAPDVSGDFTGSGDVSGHLDFSGQLSGDRASGLPSGDLDSSGLTSTVGSGLTVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDVSGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDIDECLSSPCLNGATCVDAIDSFTCLCLPSYEGDLCEIDQEVCEEGWNKYQGHCYRHFPDRETWVDAERRCREQQSHLSSIVTPEEQEFVNNNAQDYQWIGLNDRTIEGDFRWSDGHPMPPPTNADYRSGAHGTLGGAAPAQPTEKSFQDAPRTLSPGACQADVHPTQTVSSSCRFLSYKESH

SEQ ID NO: 755163 - protein, 2316 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACPGTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAETEESTEGPSATEVPSASEEPSPSEVPFPSEEPSPSEEPFPSVRPFPSVELFPSEEPFPSKEPSPSEEPSASEEPYTPSPPEPSWTELPSSGEESGAPDVSGDFTGSGDVSGHLDFSGQLSGDRASGLPSGDLDSSGLTSTVGSGLTVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDVSGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 755164 - protein, 2233 aa, Homo sapiens
MAQGEQSGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACPGTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAETEESTEGPSATEVPSASEEPSPSEVPFPSEEPSPSEEPFPSVRPFPSVELFPSEEPFPSKEPSPSEEPSASEEPYTPSPPEPSWTELPSSGEESGAPDVSGDFTGSGDVSGHLDFSGQLSGDRASGLPSGDLDSSGLTSTVGSGLTVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDVSGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 755165 - protein, 2309 aa, Homo sapiens
MAQGEQSGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACPGTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAETEESTEGPSATEVPSASEEPSPSEVPFPSEEPSPSEEPFPSVRPFPSVELFPSEEPFPSKEPSPSEEPSASEEPYTPSPPEPSWTELPSSGEESGAPDVSGDFTGSGDVSGHLDFSGQLSGDRASGLPSGDLDSSGLTSTVGSGLTVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDVSGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDIDECLSSPCLNGATCVDAIDSFTCLCLPSYEGDLCEIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 755166 - protein, 53 aa, Homo sapiens
MKLGARQWVLKTNDQEEGKIPYTFQSFDCFPLGWVPHCDMESMTQTDCLLPAR

SEQ ID NO: 755167 - protein, 37 aa, Homo sapiens
MKLADAPTRRYTHGNQFSPVLRASHSGASLMPHDHYR

SEQ ID NO: 755168 - protein, 191 aa, Homo sapiens
MGTWILFACLLGAAFAMPLPPHPGHPGYINFSYEVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 755169 - protein, 338 aa, Homo sapiens
NRKRKQAARAAEEPGAAMDVRALPWLPWLLWLLCRGGGDADSRAPFTPTWPRSREREAAAFRESLNRHRYLNSLFPSENSTAFYGINQFSYLFPEEFKAIYLRSKPSKFPRYSAEVHMSIPNVSLPLRFDWRDKQVVTQVRNQQMCGGCWAFSVVGAVESAYAIKGKPLEDLSVQQVIDCSYNNYGCNGGSTLNALNWLNKMQVKLVKDSEYPFKAQNGLCHYFSGSHSGFSIKGYSAYDFSDQEDEMAKALLTFGPLVVIVDAVSWQDYLGGIIQHHCSSGEANHAVLITGFDKTGSTPYWIVRNSWGSSWGVDGYAHVKMGSNVCGIADSVSSIFV

SEQ ID NO: 755170 - protein, 338 aa, Homo sapiens; identical to SEQ ID NO: 755169

SEQ ID NO: 755171 - protein, 338 aa, Homo sapiens; identical to SEQ ID NO: 755169

SEQ ID NO: 755172 - protein, 292 aa, Homo sapiens
NRKRKQAARAAEEPGAAMDVRALPWLPWLLWLLCRGGGDADSRAPFTPTWPRSREREAAAFRESLNRHRYLNSLFPSENSTAFYGINQFSYLFPEEFKAIYLRSKPSKFPRYSAEVHMSIPNVSLPLRFDWRDKQVVTQVRNQQMCGGCWAFSVVGAVESAYAIKGKPLEDLSVQQVIDCSYNNYGCNGGSTLNALNWLNKMQVKLVKDSEYPFKAQNGLCHYFSGSHSGFSIKGYSAYDFSDQEDEMAKGSTPYWIVRNSWGSSWGVDGYAHVKMGSNVCGIADSVSSIFV

SEQ ID NO: 755173 - protein, 136 aa, Homo sapiens
AGGTRSSATAQISTMKLLTGLVFCSLVLSVSSRSFFSFLGEAFDGARDMWRAYSDMREANYIGSDKYFHARGNYDAAKRGPGGAWAAEVISNARENIQRLTGHGAEDSLADQAANKWGRSGRDPNHFRPAGLPEKY

SEQ ID NO: 755174 - protein, 136 aa, Homo sapiens; identical to SEQ ID NO: 755173

SEQ ID NO: 755175 - protein, 122 aa, Homo sapiens; identical to SEQ ID NO: 755019

SEQ ID NO: 755176 - protein, 122 aa, Homo sapiens; identical to SEQ ID NO: 755019

SEQ ID NO: 755177 - protein, 122 aa, Homo sapiens; identical to SEQ ID NO: 755019

SEQ ID NO: 755178 - protein, 122 aa, Homo sapiens; identical to SEQ ID NO: 755019

SEQ ID NO: 755179 - protein, 136 aa, Homo sapiens; identical to SEQ ID NO: 755173

SEQ ID NO: 755180 - protein, 136 aa, Homo sapiens; identical to SEQ ID NO: 755173

SEQ ID NO: 755181 - protein, 142 aa, Homo sapiens
TSKYIDTYIYHSSATAQISTMKLLTGLVFCSLVLSVSSRSFFSFLGEAFDGARDMWRAYSDMREANYIGSDKYFHARGNYDAAKRGPGGAWAAEVISNARENIQRLTGHGAEDSLADQAANKWGRSGRDPNHFRPAGLPEKY

SEQ ID NO: 755182 - protein, 142 aa, Homo sapiens; identical to SEQ ID NO: 755181

SEQ ID NO: 755183 - protein, 97 aa, Homo sapiens
TSKYIDTYIYHSSATAQISTMKLLTGLVFCSLVLSVSSRSFFSFLGEAFDGARDMWRAYSDMREANYIGSDKYFHARGNYDAAKRGPGGAWAAEVIR

SEQ ID NO: 755184 - protein, 340 aa, Homo sapiens
MGPPHSGPGGVRVGALLLLGVLGLVSGLSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMPAVAGAAGGLALLLLGVAGAGGAMCWRRRRAKPSESRHPGPGSFGRGGSLGLGGGGGMGPREAEPGELGIALRGGGAADPPFCPHYEKVSGDYGHPVYIVQDGPPQSPPNIYYKV

SEQ ID NO: 755185 - protein, 340 aa, Homo sapiens; identical to SEQ ID NO: 755184

SEQ ID NO: 755186 - protein, 340 aa, Homo sapiens; identical to SEQ ID NO: 755184

SEQ ID NO: 755187 - protein, 210 aa, Homo sapiens
MLPLPSGVSSLPVCWFCIALISQSLIPTLWPVQSIHGPVSPRGGAVPRKPVSEMPMERDRGAAHSLEPGKENLPGDPTSNATSRGAEGPLPPPSMPAVAGAAGGLALLLLGVAGAGGAMCWRRRRAKPSESRHPGPGSFGRGGSLGLGGGGGMGPREAEPGELGIALRGGGAADPPFCPHYEKVSGDYGHPVYIVQDGPPQSPPNIYYKV

SEQ ID NO: 755188 - protein, 340 aa, Homo sapiens; identical to SEQ ID NO: 755184

SEQ ID NO: 755189 - protein, 232 aa, Homo sapiens
RCGGRGPRDAAARSASSSSSGFSLHHPLPLPASPLTPPSWARDWFPPLARCPQSQRGWGSGSAPPSSLPGPAPHAAPARSPAPPVPHLGGLTDPGVLARGPGARRAPADGPWKGSGGAERSAAGARAQQEAGPRGRWGHQLPGWSGLKSQAAKAATPGGGRLWGRSLGLGGGGGMGPREAEPGELGIALRGGGAADPPFCPHYEKVSGDYGHPVYIVQDGPPQSPPNIYYKV

SEQ ID NO: 755190 - protein, 123 aa, Homo sapiens
RCGGRGPRDAAARSASSSSSGFSLHHPLPLPASPLTPPSWARDWFPSRLAMGAPLCLSVPGSFFLGEGHRLSLLSDHDPGILVPLTHPELGAGTAHLLVGTAFFLPLTGFLFSISYSFPLFRL

SEQ ID NO: 755191 - protein, 683 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICAKVDNEILNYKDLAALPKVKSIYEVQRPDLISYEPHSRYMSDEMLERCGYGESLGTLSPYSQDIYENLDLRQRRASSPGYIDSPTYSRQGMSPTFSRSPHHYYRSGPESGRSSPYHSQLDVRSSTPTSYQAPKHFHIPAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 755192 - protein, 257 aa, Homo sapiens
GRVVNLAEACIGSPNRVICDIYENLDLRQRRASSPGYIDSPTYSRQGMSPTFSRSPHHYYRSGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKYKVKDVHRPWGSPGFLEPLHWGSPGG

SEQ ID NO: 755193 - protein, 544 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLEGNFWKSGCL

SEQ ID NO: 755194 - protein, 544 aa, Homo sapiens; identical to SEQ ID NO: 755193

SEQ ID NO: 755195 - protein, 572 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 755196 - protein, 588 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 755197 - protein, 531 aa, Homo sapiens
ALVFLLVPQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 755198 - protein, 572 aa, Homo sapiens; identical to SEQ ID NO: 755195

SEQ ID NO: 755199 - protein, 572 aa, Homo sapiens; identical to SEQ ID NO: 755195

SEQ ID NO: 755200 - protein, 534 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKYKVKDVHRPWGSPGFLEPLHWGSPGG

SEQ ID NO: 755201 - protein, 317 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKWVPLLLPQLPGPLHSVRPAPLSPCLHLQHHLPSFPSAAAFWPNSIFPSSLFPPLDPPGGVSLCLRHPPCSLHACCPFSPFWSRSPCLPLRPSLIYCPVLGPQSTLLFPSHRLPPLVITYLSLVTL

SEQ ID NO: 755202 - protein, 413 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRHLKILIYPLESALGYPNVCAKVDNEILNYKDLAALPKVKSIYEVQRPDLISYEPHSRYMSDEMLERCGYGESLGTLSPYSQDIYENLDLRQRRASSPGYIDSPTYSRQGMSPTFSRSPHHYYRSARKQSQACFCQRGA

SEQ ID NO: 755203 - protein, 91 aa, Homo sapiens
IFITHSPGSGTMQGTGCPEGTCSTHCCLQLPLHLASSCCSLSLSPHPRLPCLLQRHLSQEEFYQVFGMTISEFDRLALWKRNELKKQARLF

SEQ ID NO: 755204 - protein, 598 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRTSPGMESSSRLLLYLPHHHHLLIQQVKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 755205 - protein, 132 aa, Homo sapiens
MECSLTETESNYCAQLAQIQAQIGALEEQLHQVRTETEGQKLEYEQLLDIKVHLEKEIETYCLLIDGEDGSCSKSKGYGGPGNQTKDSSKTTIVKTVVEEIDPRGKVLSSRVHTVEEKSTKVNNKNEQRVSS

SEQ ID NO: 755206 - protein, 88 aa, Homo sapiens
MSGPGLEVGAFLALSHCYFQIISPLPSCKNHRSFDVYVIWIYHPFLDLLTIFCQHPSQISSFTEVFHSWQKVFHSNPVPSFILGDFHT

SEQ ID NO: 755207 - protein, 215 aa, Homo sapiens
MEFDCEGLRRLLGKYKFRDLTVEELRNVNVFFPHFKYSMDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKVESRSVTQAGV

SEQ ID NO: 755208 - protein, 251 aa, Homo sapiens
RIPGAAAAEPGALNAGGISSLGRGGALDRREVWSSAASVLQQVRKKVRGLESWDLARDRPGDGVRLRGPETAAWQVQVQGPNCGRTKECKCIFPTFQIFHGHLCVLLRNPGLECSDTIMAYCKLHLPGSSHLPISASPVTGTIGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGLYICQAD

SEQ ID NO: 755209 - protein, 341 aa, Homo sapiens
MDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRDIMI

SEQ ID NO: 755210 - protein, 471 aa, Homo sapiens
MEFDCEGLRRLLGKYKFRDLTVEELRNVNVFFPHFKYSMDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRAMELLRVKGQRSWSVGLSVADMVDSIVNNKKKVHSVSALAKGYYDINSEVFLSLPCILGTNGVSEVIKTTLKEDTVTEKLQSSASSIHSLQQQLKL

SEQ ID NO: 755211 - protein, 371 aa, Homo sapiens
IITSRGSSPTMATAASNPYSILSSTSLVHADSAGMQQGSPFRNPQKLLQSDYLQGVPSNGHPLGHHWVTSLSDGGPWSSTLATSPLDQQDVKPGREDLQLGAIIHHRSPHVAHHSPHTNHPNAWGASPAPNPSITSSGQPLNVYSQPGFTVSGMLEHGGLTPPPAAASAQSLHPVLREPPDHGELGSHHCQDHSDEETPTSDELEQFAKQFKQRRIKLGFTQADVGLALGTLYGNVFSQTTICRFEALQLSFKNMCKLKPLLNKWLEEADSSTGSPTSIDKIAAQGRKRKKRTSIEVSVKGVLETHFLKCPKPAAQEISSLADSLQLEKEVVRVWFCNRRQKEKRMTPPGDQQPHEVYSHTVKTDTSCHDL

SEQ ID NO: 755212 - protein, 107 aa, Homo sapiens
DKREGLNQQWKLSTPTRNGTCLEAEDEQMACNLDYQPVEAAALTQVLRSSYREKGICIMAPGSKRNGIALLGRILIHKQENKENVFLLLLSLVLTHFSEAVSLCGKI

SEQ ID NO: 755213 - protein, 218 aa, Homo sapiens
FRDSSVLFCGVTQAHYTYNNLSSDSKIRTKQLFEFMNFLAENVIFCYMGLALFTFQNHIFNALFILGAFLAILVARACNIYPLSFLLNLGRKQKIPWNFQHMMMFSGLRGAIAFALAIRNTESQPKQMMFTTTLLLVFFTVWVFGGGTTPMLTWLQIRVGVDLDENLKEDPSSQNQEANNLAQNMTKAESARILRMWYSFDHKSSETNLTHSVLDDYT

SEQ ID NO: 755214 - protein, 166 aa, Homo sapiens
FRDSSVLFCGVTQAHYTYNNLSSDSKIRTKQLFEFMNFLAENVIFCYMGLALFTFQNHIFNALFILGAFLAILVARACNIYPLSFLLNLGRKQKIPWNFQHMMMFSGLRGAIAFALAIRNTESQPKQMMFTTTLLLVFFTVWVFGGGTTPMLTWLQIRLFSKNTTK

SEQ ID NO: 755215 - protein, 93 aa, Homo sapiens
SLCPGLKLSSFLRDLNSVRDVVIEGPLSGAVVVEGGTLLELRTPLSHMVVFLSRMSGERSPNSSPEFCEIEQMRTPTIEVDPIQTMHLPPKGQ

SEQ ID NO: 755216 - protein, 190 aa, Homo sapiens
MASRGKTETSKLKQNLEEQLDRLMQQLQDLEECREELDTDEYEETKKETLEQLSEFNDSLKKIMSGNMTLVDELSGMQLAIQAAISQAFKTPEVIRLFAKKQPGQLRTRLAEMDRDLMVGKLERDLYTQQKVEILTALRKLGEKLTADDEAFLSANAGAILSQFEKVSTDLGSGDKILALASFEVEKTKK

SEQ ID NO: 755217 - protein, 190 aa, Homo sapiens; identical to SEQ ID NO: 755216

SEQ ID NO: 755218 - protein, 190 aa, Homo sapiens; identical to SEQ ID NO: 755216

SEQ ID NO: 755219 - protein, 190 aa, Homo sapiens; identical to SEQ ID NO: 755216

SEQ ID NO: 755220 - protein, 176 aa, Homo sapiens
MASRGKTETSKLKQNLEEQLDRLMQQLQDLEECREELDTDEYEETKKETLEQLSEFNDSLKKIMSGNMTLVDELSGMQLAIQAAISQAFKTPEVIRLFAKKQPGQLRTRLAEMDRDLMVGKLERDLYTQQKVEILTALRKLGEKLTADDEAFLSANAGAILSQFEKVSTDLVIAKK

SEQ ID NO: 755221 - protein, 190 aa, Homo sapiens; identical to SEQ ID NO: 755216

SEQ ID NO: 755222 - protein, 190 aa, Homo sapiens; identical to SEQ ID NO: 755216

SEQ ID NO: 755223 - protein, 205 aa, Homo sapiens
MASRGKTETSKLKQNLEEQLDRLMQQLQDLEECREELDTDEYEETKKETLEQLSEFNDSLKKIMSGNMTLVDELSGMQLAIQAAISQAFKTPEVIRLFAKKQPGQLRTRLAEMDRDLMVGKLERDLYTQQKVEILTALRKLGEKLTADDEAFLSANAGAILSQFEKVSTDLGRPPSYMNYLLDSHPSKNIDVPSKISFLLKIQDL

SEQ ID NO: 755224 - protein, 69 aa, Homo sapiens
VRASSGSAPPARSARPVPSASPPRGGLNFEPFVVLMNNFIFLKFMTLGTSRTGGLCNLRPVGTVQRSEY

SEQ ID NO: 755225 - protein, 205 aa, Homo sapiens; identical to SEQ ID NO: 755223

SEQ ID NO: 755226 - protein, 69 aa, Homo sapiens; identical to SEQ ID NO: 755224

SEQ ID NO: 755227 - protein, 102 aa, Homo sapiens
ALERRLRFGFEPSSPGPNAGLASRLGSGRRPSTLRPLSPALELGAGCQWKRGAWLCDSFILRRREPQTRCALKRGGKRGQPRMKGRAPAGLHCARRRGAGRG

SEQ ID NO: 755228 - protein, 354 aa, Homo sapiens
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKFAEKFQEFKEAARLAKEKSQEKMELTSTPSQESAGGDLQSPLTPESINGTDDERTPDVTQNSEPRAEPTQNALPFSHSSAISKHWEAELATLKGNNAKLTAALLESTANVKQWKQQLAAYQEEAERLHKRVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 755229 - protein, 184 aa, Homo sapiens
FLFYFSSAISKHWEAELATLKGNNAKLTAALLESTANVKQWKQQLAAYQEEAERLHKRVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 755230 - protein, 155 aa, Homo sapiens
EPAPSLWVLGVCWWLAVGAAEESCAAAHTVCLSSQSGVNAVSAGVCWVLSLVISVPLKWAQKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 755231 - protein, 354 aa, Homo sapiens; identical to SEQ ID NO: 755228

SEQ ID NO: 755232 - protein, 238 aa, Homo sapiens
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKFAEKFQEFKEAARLAKEKSQEKMELTSTPSQESAGGDLQSPLTPESINGTDDERTPDVTQNSEPRAEPTQNALPFSHSSAISKHWEAELATLKGNNAKLTAALLESTANVKQWKQQLAAYQEEAERLHKRVISGLMSIGI

SEQ ID NO: 755233 - protein, 107 aa, Homo sapiens
CLGDSRDPLKWAQKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 755234 - protein, 354 aa, Homo sapiens; identical to SEQ ID NO: 755228

SEQ ID NO: 755235 - protein, 107 aa, Homo sapiens; identical to SEQ ID NO: 755233

SEQ ID NO: 755236 - protein, 94 aa, Homo sapiens
GIQVTKRFSGDTESRLQKIMVLDGFLVCKKLQEVEIRNKDLEGQLSDLEQRLEKSQNEQEAFRNNLKTLLEILDGKIFELTELRDNLAKLLECS

SEQ ID NO: 755237 - protein, 102 aa, Homo sapiens; identical to SEQ ID NO: 755227

SEQ ID NO: 755238 - protein, 527 aa, Homo sapiens
AVRGVGARVYADAPAKLLLPPPAAWDLAVRLRGAEAASERQVYSVTMKLLLLHPAFQSCLLLTLLGLWRTTPEAHASSPGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMMEFCSVAQAGVQWCHLSSLQPLPLGLKRLSCLSLPSN

SEQ ID NO: 755239 - protein, 538 aa, Homo sapiens
AVRGVGARVYADAPAKLLLPPPAAWDLAVRLRGAEAASERQVYSVTMKLLLLHPAFQSCLLLTLLGLWRTTPEAHASSPGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 755240 - protein, 67 aa, Homo sapiens
IARYEAALRDVLYISLGLIFPEMNEVCQEDERKGSILIPFIIQNLGLLTGFTIMVVLTMYSGQIQIG

SEQ ID NO: 755241 - protein, 538 aa, Homo sapiens; identical to SEQ ID NO: 755239

SEQ ID NO: 755242 - protein, 538 aa, Homo sapiens; identical to SEQ ID NO: 755239

SEQ ID NO: 755243 - protein, 538 aa, Homo sapiens; identical to SEQ ID NO: 755239

SEQ ID NO: 755244 - protein, 538 aa, Homo sapiens; identical to SEQ ID NO: 755239

SEQ ID NO: 755245 - protein, 83 aa, Homo sapiens
GPPQAAGVSPPSVIEALVCSCSSTVWGFGFLSVSLINLASLLGVLVLPCTEKAFFSRVLTYFIALSIGTLLSNALFQLIPEVQ

SEQ ID NO: 755246 - protein, 538 aa, Homo sapiens; identical to SEQ ID NO: 755239

SEQ ID NO: 755247 - protein, 538 aa, Homo sapiens
AVRGVGARVYADAPAKLLLPPPAAWDLAVRLRGAEAASERQVYSVTMKLLLLHPAFQSCLLLTLLGLWRTTPEAHASSPGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGFGFLSVSLINLASLLGVLVLPCTEKAFFSRVLTYFIALSIGTLLSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 755248 - protein, 538 aa, Homo sapiens; identical to SEQ ID NO: 755239

SEQ ID NO: 755249 - protein, 538 aa, Homo sapiens; identical to SEQ ID NO: 755239

SEQ ID NO: 755250 - protein, 538 aa, Homo sapiens; identical to SEQ ID NO: 755239

SEQ ID NO: 755251 - protein, 538 aa, Homo sapiens; identical to SEQ ID NO: 755239

SEQ ID NO: 755252 - protein, 44 aa, Homo sapiens
MITLSDGLHNFIDGLAIGASFTVSVFQGISTSVAILCEEFPHEL

SEQ ID NO: 755253 - protein, 191 aa, Homo sapiens
MAGSSTGGGGVGETKVIYHLDEEETPYLVKIPVPAERITLGDFKSVLQRPAGAKYFFKSMDQDFGVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSSEHGVGVHEFVAPSGWVPFGRL

SEQ ID NO: 755254 - protein, 70 aa, Homo sapiens
DNASPLECRGAAHSSATGKKAHKQGHQHRNMPAAHTSGQSHQPAKSSSGPQTSGPDAARKLHMPGIPRVL

SEQ ID NO: 755255 - protein, 67 aa, Homo sapiens
CPTCRRFQVNDMNFENMSNDDAVRVLRDIVHKPGPIVLTVAKCWDPSPQAYFTLPRTVTCKGSRARN

SEQ ID NO: 755256 - protein, 710 aa, Homo sapiens
IGPAGALLEWIGRHGGAHVYFGPHWDFLAYGGADCTMLRVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSSEHGAGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDPSPQAYFTLPRNEPIQPIDPAAWVSHSAALTGTFPAYPGSSSMSTITSGSSLPDGCEGRGLSVHTDMASVTKAMAAPESGLEVRDRMWLKITIPNAFLGSDVVDWLYHHVEGFPERREARKYASGLLKAGLIRHTVNKITFSEQCYYVFGDLSGGCESYLVNLSLNDNDGSSGASDQDTLAPLPGATPWPLLPTFSYQYPAPHPYSPQPPPYHELSSYTYGGGSASSQHSEGSRSSGSTRSDGGAGRTGRPEERAPESKSGSGSESEPSSRGGSLRRGGEASGTSDGGPPPSRGSTGGAPNLRAHPGLHPYGPPPGMALPYNPMMVVMMPPPPPPVPPAVQPPGAPPVRDLGSVPPELTASRQSFHMAMGNPSEFFVDVM

SEQ ID NO: 755257 - protein, 586 aa, Homo sapiens
MAGSSTGGGGVGETKVIYHLDEEETPYLVKIPVPAERITLGDFKSVLQRPAGAKYFFKSMDQDFGVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSSEHGAGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDPSPQAYFTLPRNEPIQPIDPAAWVSHSAALTGTFPAYPGSSSMSTITSGSSLPDGCEGRGLSVHTDMASVTKAMAAPESGLEVRDRMWLKITIPNAFLGSDVVDWLYHHVEGFPERREARKYASGLLKAGLIRHTVNKITFSEQCYYVFGDLSGGCESYLVNLSLNDNDGSSGASDQDTLAPLPGATPWPLLPTFSYQYPAPHPYSPQPPPYHDFHMAMGNPSEFFVDVM

SEQ ID NO: 755258 - protein, 73 aa, Homo sapiens
QRREQELEEEPEAFFQLWVLPGSDVVDWLYHHVEGFPERREARKYASGLLKAGLIRHTVNKITFSEQCYYVFG

SEQ ID NO: 755259 - protein, 736 aa, Homo sapiens
MAGSSTGGGGVGETKVIYHLDEEETPYLVKIPVPAERITLGDFKSVLQRPAGAKYFFKSMDQDFGVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSSEHGAGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDPSPQAYFTLPRNEPIQPIDPAAWVSHSAALTGTFPAYPGSSSMSTITSGSSLPDGCEGRGLSVHTDMASVTKAMAAPESGLEVRDRMWLKITIPNAFLGSDVVDWLYHHVEGFPERREARKYASGLLKAGLIRHTVNKITFSEQCYYVFGDLSGGCESYLVNLSLNDNDGSSGASDQDTLAPLPGATPWPLLPTFSYQYPAPHPYSPQPPPYHELSSYTYGGGSASSQHSEGSRSSGSTRSDGGAGRTGRPEERAPESKSGSGSESEPSSRGGSLRRGGEASGTSDGGPPPSRGSTGGAPNLRAHPGLHPYGPPPGMALPYNPMMVVMMPPPPPPVPPAVQPPGAPPVRDLGSVPPELTASRQSFHMAMGNPSEFFVDVM

SEQ ID NO: 755260 - protein, 736 aa, Homo sapiens; identical to SEQ ID NO: 755259

SEQ ID NO: 755261 - protein, 492 aa, Homo sapiens
MAGSSTGGGGVGETKVIYHLDEEETPYLVKIPVPAERITLGDFKSVLQRPAGAKYFFKSMDQDFGVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSSEHGAGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDPSPQAYFTLPRNEPIQPIDPAAWVSHSAALTGTFPAYPGSSSMSTITSGSSLPDGCEGRGLSVHTDMASVTKAMAAPESGLEVRDRMWLKITIPNAFLGSDVVDWLYHHVEGFPERREARGCSGGAGGHVVAGEDA

SEQ ID NO: 755262 - protein, 217 aa, Homo sapiens
QSGLKLQYFLINHGTVTGNSPYCNPRPDWHEERCNNEEFSSSVNALALTLPFLAVEVQNQKQPACHENDERPFYQKTAPYVPMYYVPNSYPYYGTNLYQRRPAIAINNPYVPRTYYANPAVVRPHAQIPQRQYLPNSHPPTVVRRPNLHPSFIAIPPKKIQDKIIIPTINTIATVEPTPAPATEPTVDSVVTPEAFSESIITSTPETTTVAVTPPTA

SEQ ID NO: 755263 - protein, 206 aa, Homo sapiens
MGKRDNRVAYMNPIAMARWRGPTQSVGPTIQDYLNRPRPTWEEVKKQLENKKTGSKALAEFEEKMNENWKKELEKSREKLLSGNESSSKKRERKKKRKKKSCRSSSSSSSSDSSSSSSDSEDEEKKQGKRRKKKKNRSYKSSQSSTHESESESKESVKKKKKSKDETEKEKDVRSLSKKRKKSYPDDKPLSSESSSESDYEEDVQA

SEQ ID NO: 755264 - protein, 81 aa, Homo sapiens
GLHFNIRVDHGMLWAPVLYKDVGQELPVVSTAPSHIALLMEPFTPDVLSRLMGRIQVCKDYVIDQLWSVLKEICQWIIPYG

SEQ ID NO: 755265 - protein, 252 aa, Homo sapiens
SLSGKMLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 755266 - protein, 111 aa, Homo sapiens
TYLQTCRQQLTLTQRSSGSGNNSSSAFSTMSLRLDTTPSCNSARPLHALQVLLLLSLLLTALASSTKGQTKRNLAKGKEESLDSDLYAELRCMCIKTTSGNSSQKHPKFGK

SEQ ID NO: 755267 - protein, 263 aa, Homo sapiens
LLRVPESKMAGSRQRGLRARVRPLFCALLLSLGRFVRGDGVGGDPAVALPHRRFEYKYSFKGPHLVQSDGTVPFWAHAGNAIPSSDQIRVAPSLKSQRGSVWTKTKAAFENWEVEVTFRVTGRGRIGADGLAIWYAENQGLEGPVFGSADLWNGVGIFFDSFDNDGKKNNPAIVIIGNNGQIHYDHQNDGASQALASCQRDFRNKPYPVRAKITYYQNTLTVMINNGFTPDKNDYEFCAKVGKYDYPCTRAFWNICCNWRSCR

SEQ ID NO: 755268 - protein, 263 aa, Homo sapiens; identical to SEQ ID NO: 755267

SEQ ID NO: 755269 - protein, 263 aa, Homo sapiens; identical to SEQ ID NO: 755267

SEQ ID NO: 755270 - protein, 263 aa, Homo sapiens; identical to SEQ ID NO: 755267

SEQ ID NO: 755271 - protein, 263 aa, Homo sapiens; identical to SEQ ID NO: 755267

SEQ ID NO: 755272 - protein, 293 aa, Homo sapiens
MALHQIKMIMNFVPKWENMIIPAQGHFGISAATGGLADDHDVLSFLTFQLTEPGKEPPTPDKEISEKEKEKYQEEFEHFQQELDKKKEEFQKGHPDLQGQPAEEIFESVGDRELRQVFEGQNRIHLEIKQLNRQLDMILDEQRRYVSSLTEEISKRGAGMPGQHGQITQQELDTVVKTQHEILRQVNEMKNSMSETVRLVSGMQHPGSAGGVYETTQHFIDIKEHLHIVKRDIDNLVQRNMPSNEKPKCPELPPFPSCLSTVHFIIFVVVQTVLFIGYIMYRSQQEAAAKKFF

SEQ ID NO: 755273 - protein, 266 aa, Homo sapiens
PTTAKKPSLADDHDVLSFLTFQLTEPGKEPPTPDKEISEKEKEKYQEEFEHFQQELDKKKEEFQKGHPDLQGQPAEEIFESVGDRELRQVFEGQNRIHLEIKQLNRQLDMILDEQRRYVSSLTEEISKRGAGMPGQHGQITQQELDTVVKTQHEILRQVNEMKNSMSETVRLVSGMQHPGSAGGVYETTQHFIDIKEHLHIVKRDIDNLVQRNMPSNEKPKCPELPPFPSCLSTVHFIIFVVVQTVLFIGYIMYRSQQEAAAKKFF

SEQ ID NO: 755274 - protein, 263 aa, Homo sapiens; identical to SEQ ID NO: 755267

SEQ ID NO: 755275 - protein, 263 aa, Homo sapiens; identical to SEQ ID NO: 755267

SEQ ID NO: 755276 - protein, 263 aa, Homo sapiens; identical to SEQ ID NO: 755267

SEQ ID NO: 755277 - protein, 263 aa, Homo sapiens; identical to SEQ ID NO: 755267

SEQ ID NO: 755278 - protein, 293 aa, Homo sapiens; identical to SEQ ID NO: 755272

SEQ ID NO: 755279 - protein, 263 aa, Homo sapiens; identical to SEQ ID NO: 755267

SEQ ID NO: 755280 - protein, 263 aa, Homo sapiens; identical to SEQ ID NO: 755267

SEQ ID NO: 755281 - protein, 153 aa, Homo sapiens
MKLTIDHTPERKDEKERIKKCGGFVAWNSLGQPHVNGRLAMTRSIGDLDLKTSGVIAEPETKRIKLHHADDSFLVLTTDGINFMVNSQEICDFVNQCHDPNEAAHAVTEQAIQYGTEDNSTAVVVPFGAWGKYKNSEINFSFSRSFASSGRWA

SEQ ID NO: 755282 - protein, 372 aa, Homo sapiens
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMDLLPKEKNLETLLTLAFLEIDKAFSSHARLSADATLLTSGTTATVALLRDGIELVVASVGDSRAILCRKGKPMKLTIDHTPERKDEKERIKKCGGFVAWNSLGQPHVNGRLAMTRSIGDLDLKTSGVIAEPETKRIKLHHADDSFLVLTTDGINFMVNSQEICDFVNQCHDPNEAAHAVTEQAIQYGTEDNSTAVVVPFGAWGKYKNSEINFSFSRSFASSGRWA

SEQ ID NO: 755283 - protein, 153 aa, Homo sapiens; identical to SEQ ID NO: 755281

SEQ ID NO: 755284 - protein, 153 aa, Homo sapiens; identical to SEQ ID NO: 755281

SEQ ID NO: 755285 - protein, 352 aa, Homo sapiens [sequence omitted]

SEQ ID NO: 755286 - protein, 133 aa, Homo sapiens [sequence omitted]

SEQ ID NO: 755287 - protein, 372 aa, Homo sapiens; identical to SEQ ID NO: 755282

SEQ ID NO: 755288 - protein, 392 aa, Homo sapiens
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMDLLPKEKNLETLLTLAFLEIDKAFSSHARLSADGLWLIHFESPVCSTLHENLAATLLTSGTTATVALLRDGIELVVASVGDSRAILCRKGKPMKLTIDHTPERKDEKERIKKCGGFVAWNSLGQPHVNGRLAMTRSIGDLDLKTSGVIAEPETKRIKLHHADDSFLVLTTDGINFMVNSQEICDFVNQCHDPNEAAHAVTEQAIQYGTEDNSTAVVVPFGAWGKYKNSEINFSFSRSFASSGRWA

SEQ ID NO: 755289 - protein, 153 aa, Homo sapiens; identical to SEQ ID NO: 755281

SEQ ID NO: 755290 - protein, 153 aa, Homo sapiens; identical to SEQ ID NO: 755281

SEQ ID NO: 755291 - protein, 153 aa, Homo sapiens; identical to SEQ ID NO: 755281

SEQ ID NO: 755292 - protein, 311 aa, Homo sapiens
MTESQGTVTFKDVAIDFTQEEWKRLDPAQRKLYRNVMLENYNNLITVGYPFTKPDVIFKLEQEEEPWVMEEEVLRRHWQGEIWGVDEHQKNQDRLLRQVEVKFQKTLTEEKGNECQKKFANVFPLNSDFFPSRHNLYEYDLFGKCLEHNFDCHNNVKCLMRKEHCEYNEPVKSYGNSSSHFVITPFKCNHCGKGFNQTLDLIRHLRIHTGEKPYECSNCRKAFSHKEKLIKHYKIHSREQSYKCNECGKAFIKMSNLIRHQRIHTGEKPYACKECEKSFSQKSNLIDHEKIHTGEKPYECNECGKAFSQKQ

SEQ ID NO: 755293 - protein, 311 aa, Homo sapiens; identical to SEQ ID NO: 755292

SEQ ID NO: 755294 - protein, 335 aa, Homo sapiens
MDSARHHISHSTSAGPIPSQKEEEMTESQGTVTFKDVAIDFTQEEWKRLDPAQRKLYRNVMLENYNNLITVGYPFTKPDVIFKLEQEEEPWVMEEEVLRRHWQGEIWGVDEHQKNQDRLLRQVEVKFQKTLTEEKGNECQKKFANVFPLNSDFFPSRHNLYEYDLFGKCLEHNFDCHNNVKCLMRKEHCEYNEPVKSYGNSSSHFVITPFKCNHCGKGFNQTLDLIRHLRIHTGEKPYECSNCRKAFSHKEKLIKHYKIHSREQSYKCNECGKAFIKMSNLIRHQRIHTGEKPYACKECEKSFSQKSNLIDHEKIHTGEKPYECNECGKAFSQKQ

SEQ ID NO: 755295 - protein, 118 aa, Homo sapiens [sequence omitted]

SEQ ID NO: 755296 - protein, 335 aa, Homo sapiens; identical to SEQ ID NO: 755294

SEQ ID NO: 755297 - protein, 335 aa, Homo sapiens; identical to SEQ ID NO: 755294

SEQ ID NO: 755298 - protein, 230 aa, Homo sapiens
MARKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFHVTNTQKLLGGGPEKFNILGAGREKGTSKTGLHGVSKNRARLTRGGWLR

SEQ ID NO: 755299 - protein, 146 aa, Homo sapiens
ALGEVGWRPALRQNFSSWVEENAFGVRPWRGEPCSQGGDTADYPPCAFRWLLRGERGLAGGCGREGSQRRLQPGPRNADRCAFSLPKPALGKFSQEKAMFSSSAKIVKPNGEEAGRVRVRHLPGSSGAGDELGPQGSAQGAEYYGS

SEQ ID NO: 755300 - protein, 114 aa, Homo sapiens
MLAAARVLGPGCSDARSGSVLLFVASLALLELEMNSDLKAQLRELNITAAKEIEVGGGRKAIIIFVPVPQLKSFQKIQVRLVRELEKKFSGKHVVFIAQVSVLLLQHVSVCEFC

SEQ ID NO: 755301 - protein, 215 aa, Homo sapiens
MARKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKKPHGPRCSFLNSPEYPFVNQTMTYITKALLLTVQHTTTQHTGTSSKS

SEQ ID NO: 755302 - protein, 157 aa, Homo sapiens
MARKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKVGYYALAG

SEQ ID NO: 755303 - protein, 134 aa, Homo sapiens
MARKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSPVLKLHGLPIPFKLWVFPKKICWAKE

SEQ ID NO: 755304 - protein, 118 aa, Homo sapiens
MARKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKTWSSQAKLWARESASN

SEQ ID NO: 755305 - protein, 159 aa, Homo sapiens
MARKPDEFESGISQEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 755306 - protein, 118 aa, Homo sapiens; identical to SEQ ID NO: 755304

SEQ ID NO: 755307 - protein, 183 aa, Homo sapiens
MARKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 755308 - protein, 174 aa, Homo sapiens
MARKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKTRGRDVN

SEQ ID NO: 755309 - protein, 183 aa, Homo sapiens; identical to SEQ ID NO: 755307

SEQ ID NO: 755310 - protein, 174 aa, Homo sapiens; identical to SEQ ID NO: 755308

SEQ ID NO: 755311 - protein, 174 aa, Homo sapiens
MARKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKGQVNFCVYKKLTLVHCNKMTNKKYK

SEQ ID NO: 755312 - protein, 111 aa, Homo sapiens
MARKPDEFESGISQALLELEMNSDLKAQLRELNITAAKEIEVGGGRKAIIIFVPVPQLKSFQKIQVRLVRELEKKFSGKHVVFIAQVSVLLLQHVSVCEFCYKLLVFRLHW

SEQ ID NO: 755313 - protein, 144 aa, Homo sapiens
LWGGIRGKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 755314 - protein, 145 aa, Homo sapiens
MPAYIFKIFKKQELASSCFLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 755315 - protein, 429 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 755316 - protein, 429 aa, Homo sapiens; identical to SEQ ID NO: 755315

SEQ ID NO: 755317 - protein, 429 aa, Homo sapiens; identical to SEQ ID NO: 755315

SEQ ID NO: 755318 - protein, 91 aa, Homo sapiens
HEDITLGSRSAPSGGGASFNLSLTEEHSGNYSCEANNGLGAQRSEAVTLNFTGIAQAMELSWSMSPSQRPGRVLLVPLCFRGFATHGGASV

SEQ ID NO: 755319 - protein, 340 aa, Homo sapiens
MLPRLLLLICAPLCEPAGVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 755320 - protein, 139 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQGSQGPGCSGGCAGASL

SEQ ID NO: 755321 - protein, 87 aa, Homo sapiens
MGGSRVSCSQNLCFVILFSLCFHQNVTSYWALLGTNTGTASESSAWSQPHRWSSVNVDRIRVRKERMALDPMMQASSRHVSTGSLGE

SEQ ID NO: 755322 - protein, 37 aa, Homo sapiens
TKPISAEFLSTVVESSGYWLLSHRAILPDIHRVLTIT

SEQ ID NO: 755323 - protein, 129 aa, Homo sapiens
CRWVLVTGDSNCTLSFQPLIEQRLCCSSQPMAAGLVARQWKAETRRPFLGRKKGEREGRSKKEAHSPKACSLLRVWPRAGGMGMGVKSSQPLLSVVYSWWTAPLSELEAPERRRGNARTCTSCEGQRNL

SEQ ID NO: 755324 - protein, 407 aa, Homo sapiens
MAAPCAEDPSLERHFKGHRDAVTCVDFSINTKQLASGSMDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLPEVDFPVPPGRGRSVESVQSQPQEPVSVPQTLTSTLEHIVGQLDVLTQTVSILEQRLTLTEDKLKQCLENQQLIMQRATP

SEQ ID NO: 755325 - protein, 359 aa, Homo sapiens
MAAPCAEDPSLERHFKGHRDAVTCVDFSINTKQLASGSMDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLTVSILEQRLTLTEDKLKQCLENQQLIMQRATP

SEQ ID NO: 755326 - protein, 305 aa, Homo sapiens
MSTVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLPEVDFPVPPGRGRSVESVQSQPQEPVSVPQTLTSTLEHIVGQLDVLTQTVSILEQRLTLTEDKLKQCLENQQLIMQRATP

SEQ ID NO: 755327 - protein, 201 aa, Homo sapiens
DFSRILRQLDPRHRLLKLYKLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLPEVDFPVPPGRGRSVESVQSQPQEPVSVPQTLTSTLEHIVGQLDVLTQTVSILEQRLTLTEDKLKQCLENQQLIMQRATP

SEQ ID NO: 755328 - protein, 255 aa, Homo sapiens
MAAPCAEDPSLERHFKGHRDAVTCVDFSINTKQLASGSMDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLWTSHHCCLFKNGGVFCFWRL

SEQ ID NO: 755329 - protein, 77 aa, Homo sapiens
PAKLASSMGNLGFPGTETVSGNWFYELAKVTQPHREPRRTAASQLTVSILEQRLTLTEDKLKQCLENQQLIMQRATP

SEQ ID NO: 755330 - protein, 407 aa, Homo sapiens; identical to SEQ ID NO: 755324

SEQ ID NO: 755331 - protein, 408 aa, Homo sapiens
GWCESDEEDPSLERHFKGHRDAVTCVDFSINTKQLASGSMDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLPEVDFPVPPGRGRSVESVQSQPQEPVSVPQTLTSTLEHIVGQLDVLTQTVSILEQRLTLTEDKLKQCLENQQLIMQRATP

SEQ ID NO: 755332 - protein, 407 aa, Homo sapiens; identical to SEQ ID NO: 755324

SEQ ID NO: 755333 - protein, 161 aa, Homo sapiens
MPHGLAHEAAVTRLPLHWPQGCRHLCELLSFGTPACFRLPRKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLWTSHHCCLFKNGGVFCFWRL

SEQ ID NO: 755334 - protein, 405 aa, Homo sapiens
SRSGYSHPAPPRHCPRRSLFSSVLKALRAAPFSRCPASVHPQWVRRAGWRAAELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGLGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDERRGGSQGLGGGGQGLLLAASRL

SEQ ID NO: 755335 - protein, 1197 aa, Homo sapiens
LLPLRHLCQPFLRTKNSSRPVPLPWPRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKENKELLKDVEVVRPLEKEAVGQLKPTGKEDTQTLQSLQKENQELMKSLEGNLETFLFPGTENQELVSSLQENLESLTALEKENQEPLRSPEVGDEEALRPLTKENQEPLRSLEDENKEAFRSLEKENQEPLKTLEEEDQSIVRPLETENHKSLRSLEEQDQETLRTLEKETQQRRRSLGEQDQMTLRPPEKVDLEPLKSLDQEIARPLENENQEFLKSLKEESVEAVKSLETEILESLKSAGQENLETLKSPETQAPLWTPEEINQGAMNPLEKEIQEPLESVEVNQETFRLLEEENQESLRSLGAWNLENLRSPEEVDKESQRNLEEEENLGKGEYQESLRSLEEEGQELPQSADVQRWEDTVEKDQELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGPGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDELGETLPDSTPLGFYLRSPTSPRWDPTGEQRPPPQGETGKEGWDPAVLASEGLEAPPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEEVGQGMPLVSEGDRGSPFQEEEGSALKTSWAGAPVHLGQGQFLKFTQREGDRESWSSGED

SEQ ID NO: 755336 - protein, 747 aa, Homo sapiens
VRRRLSSEMVFLKKTFHYRSLGAWNLENLRSPEEVDKESQRNLEEEENLGKGEYQESLRSLEEEGQELPQSADVQRWEDTVEKDQELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGLGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDELGETLPDSTPLGFYLRSPTSPRWDPTGEQRPPPQGETGKEGWDPAVLASEGLEAPPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEEVGQGMPLVSEGDRGSPFQEEEGSALKTSWAGAPVHLGQGQFLKFTQREGDRESWSSGED

SEQ ID NO: 755337 - protein, 1220 aa, Homo sapiens
MQRSEPRMLLSLCSRHRVGGNRLPEPLRAEARVAIPASVLPGPEEPGGQRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKENKELLKDVEVVRPLEKEAVGQLKPTGKEDTQTLQSLQKENQELMKSLEGNLETFLFPGTENQELVSSLQENLESLTALEKENQEPLRSPEVGDEEALRPLTKENQEPLRSLEDENKEAFRSLEKENQEPLKTLEEEDQSIVRPLETENHKSLRSLEEQDQETLRTLEKETQQRRRSLGEQDQMTLRPPEKVDLEPLKSLDQEIARPLENENQEFLKSLKEESVEAVKSLETEILESLKSAGQENLETLKSPETQAPLWTPEEINQGAMNPLEKEIQEPLESVEVNQETFRLLEEENQESLRSLGAWNLENLRSPEEVDKESQRNLEEEENLGKGEYQESLRSLEEEGQELPQSADVQRWEDTVEKDQELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGPGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDELGETLPDSTPLGFYLRSPTSPRWDPTGEQRPPPQGETGKEGWDPAVLASEGLEAPPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEEVGQGMPLVSEGDRGSPFQEEEGSALKTSWAGAPVHLGQGQFLKFTQREGDRESWSSGED

SEQ ID NO: 755338 - protein, 1220 aa, Homo sapiens; identical to SEQ ID NO: 755337

SEQ ID NO: 755339 - protein, 1220 aa, Homo sapiens; identical to SEQ ID NO: 755337

SEQ ID NO: 755340 - protein, 123 aa, Homo sapiens
MAVSHSVKERTISENSLIILLQGLQGRVTTVDLRDESVAHGRIDNVDAFMNIRLAKVTYTDRWGHQVKLDDLFVTGRNVRYVHIPDDVNITSTIEQQLQIIHRVRNFGGKGQGRWEFPPKNCK

SEQ ID NO: 755341 - protein, 123 aa, Homo sapiens; identical to SEQ ID NO: 755340

SEQ ID NO: 755342 - protein, 121 aa, Homo sapiens [sequence omitted]

SEQ ID NO: 755343 - protein, 123 aa, Homo sapiens; identical to SEQ ID NO: 755340

SEQ ID NO: 755344 - protein, 123 aa, Homo sapiens; identical to SEQ ID NO: 755340

SEQ ID NO: 755345 - protein, 123 aa, Homo sapiens; identical to SEQ ID NO: 755340

SEQ ID NO: 755346 - protein, 111 aa, Homo sapiens
AAGGRQPVQAPASFGGDPDGESGRNVAWWVRVGGAGSPGAECGGCQDLRKEVPEPRKRFLPHLPSIAPFPRPAPAALSKRCSSRFTGSLASLEKLSGLLSDRPPRRWQSLF

SEQ ID NO: 755347 - protein, 127 aa, Homo sapiens
MDPLSETCTLPGPGAGSLPCRLCMALPCLSPRVPMAMLLTCISHLLSMSPTGDVQELLKLSPQVQTMGNQQGGDPQTLCLTTLCHMVISTTPQPPQLLTSGLKQVFSSHKVPNGTQVLLLWDSSKLN

SEQ ID NO: 755348 - protein, 107 aa, Homo sapiens
WNVTEVTLLSCCPSGLIPSFPSKLGGRHHYQRRHFIDEEAEARGCLGTCPRLPSKDSSWASCAIAKLHFTFFLETEYLALLPRLGCNGAISAHCNLRFLGSSNSLAS

SEQ ID NO: 755349 - protein, 353 aa, Homo sapiens
PDFRFGGEDPSECRGCGVWSARGEFSGLVGSQAIMPRGQKSKLRAREKRRKARDETRGLNVPQVTEAEEEEAPCCSSSVSGGAASSSPAAGIPQKPQRAPTTAAAAAAGVSSTKSKKGAKSHQGEKNASSSQASTSTKSPSEDPLTRKSGSLVQFLLYKYKIKKSVTKGEMLKIVGKRFREHFPEILKKASEGLSVVFGLELNKVNPNGHTYTFIDKVDLTDEESLLSSWDFPRRKLLMPLLGVIFLNGNSATEEEIWEFLNMLGVYDGEEHSVFGEPWKLITKDLVQEKYLEYKQVPSSDPPRFQFLWGPRAYAETSKMKVLEFLAKVNGTTPCAFPTHYEEALKDEEKAGV

SEQ ID NO: 755350 - protein, 353 aa, Homo sapiens; identical to SEQ ID NO: 755349

SEQ ID NO: 755351 - protein, 397 aa, Homo sapiens
AAGAGGGGGGGGRRMSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCV

SEQ ID NO: 755352 - protein, 311 aa, Homo sapiens
MLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCV

SEQ ID NO: 755353 - protein, 212 aa, Homo sapiens
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 755354 - protein, 212 aa, Homo sapiens; identical to SEQ ID NO: 755353

SEQ ID NO: 755355 - protein, 212 aa, Homo sapiens; identical to SEQ ID NO: 755353

SEQ ID NO: 755356 - protein, 212 aa, Homo sapiens; identical to SEQ ID NO: 755353

SEQ ID NO: 755357 - protein, 212 aa, Homo sapiens; identical to SEQ ID NO: 755353

SEQ ID NO: 755358 - protein, 212 aa, Homo sapiens; identical to SEQ ID NO: 755353

SEQ ID NO: 755359 - protein, 212 aa, Homo sapiens; identical to SEQ ID NO: 755353

SEQ ID NO: 755360 - protein, 212 aa, Homo sapiens; identical to SEQ ID NO: 755353

SEQ ID NO: 755361 - protein, 212 aa, Homo sapiens; identical to SEQ ID NO: 755353

SEQ ID NO: 755362 - protein, 212 aa, Homo sapiens; identical to SEQ ID NO: 755353

SEQ ID NO: 755363 - protein, 212 aa, Homo sapiens; identical to SEQ ID NO: 755353

SEQ ID NO: 755364 - protein, 212 aa, Homo sapiens; identical to SEQ ID NO: 755353

SEQ ID NO: 755365 - protein, 196 aa, Homo sapiens
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEDSRLGAAAVESVFTV

SEQ ID NO: 755366 - protein, 212 aa, Homo sapiens; identical to SEQ ID NO: 755353

SEQ ID NO: 755367 - protein, 212 aa, Homo sapiens; identical to SEQ ID NO: 755353

SEQ ID NO: 755368 - protein, 166 aa, Homo sapiens
MITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 755369 - protein, 188 aa, Homo sapiens
MAYAYLFKYIIIGDTGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 755370 - protein, 188 aa, Homo sapiens; identical to SEQ ID NO: 755369

SEQ ID NO: 755371 - protein, 192 aa, Homo sapiens
CLFWFYGRVVCSGWLMVIVGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 755372 - protein, 181 aa, Homo sapiens
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKRHLLIQQKKFMKKFKKESLTLIMRQMALKLALSMLLPMQHMQAIREDSRLGAAAVESVFTV

SEQ ID NO: 755373 - protein, 191 aa, Homo sapiens
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEYIHINIVGQY

SEQ ID NO: 755374 - protein, 121 aa, Homo sapiens
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKR

SEQ ID NO: 755375 - protein, 125 aa, Homo sapiens
PAAPAAAELPGRRGGGAEAPRRLLLFGWARSGAVSLGSAGVSSSGFLTAPHSRRLTAAAAAAGGAWRFEAERHRGWGAEEEQQREEEPCALALSGRGHGVSRLSGTGVGARRRSSSGRRSRVPWH

SEQ ID NO: 755376 - protein, 74 aa, Homo sapiens
LTINCICLMSWIQYRTGTLGHHWLCTTPVPHSHGVDGAPFSPKTCPTSSGVPSPQAIDRYLVHGLLGTQPHSRR

SEQ ID NO: 755377 - protein, 162 aa, Homo sapiens
EKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCK

SEQ ID NO: 755378 - protein, 497 aa, Homo sapiens
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKGQWHSDVFSGLGSMAHCSGVTYYGLWINGHPAEQATRIVILGPEVMEVAQGSPFSVNVQLLQDHGEIAKSESGRVLQISAGVRYVQLSAYSEVNFFKVDRDNQETLIQTPFGFECIPYPVSSPAAGVPGPRAAKGGAEADVPLPRGDLELHLGALHGQEDTPGGLLARGHAPHCPGACQRVEQGCAEFTDVLLGPPPPGYHPFLFLDSLHKKAGGRSRGGLHPRGTPPTAQEPPGGSRPEGRATEEQAAAAHLGEYVLMIRDVTTPPFLGRRLPPAFKHLRVVAKRAGQPPHVLEEGPEASSSWQAAHSCTPEPPAPR

SEQ ID NO: 755379 - protein, 453 aa, Homo sapiens
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKGQWHSDVFSGLGSMAHCSGVTYYGLWINGHPAEQATRIVILGPEVMEVAQGSPFSVNVQLLQDHGEIAKSESGRVLQISAGVRYVQLSAYSEVNFFKVDRDNQETLIQTPFGFECIPYPVSSPAAGVPGPRAAKGGAEADVPLPRGDLELHLGALHGQEDTPGGLLARGHAPHCPGACQRVEQGCAEFTDVLLGPPPPGYHPFLFLDSLHKKAGGRSRGGLHPRGTPPTAQEPPGGSRPEGRATEEQAAAAHLGEYVLMIRDVTTPCPQEATSV

SEQ ID NO: 755380 - protein, 180 aa, Homo sapiens
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKL

SEQ ID NO: 755381 - protein, 204 aa, Homo sapiens
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKGQWHSDVFSGLGSMAHCSGVTYYGL

SEQ ID NO: 755382 - protein, 205 aa, Homo sapiens
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGLAPTGAGCCEGGRFQDMESYVHLGSGTSERACLTSEGWKGGRGPMPSSPHHQAMSYARHTPVCPAGPAALDAALSSATAEQTPVA

SEQ ID NO: 755383 - protein, 837 aa, Homo sapiens
MTESREVIDLDPPAETSQEQEDLFIVKVEEEDCTWMQEYNPPTFETFYQRFRHFQYHEASGPREALSQLRVLCCEWLRPELHTKEQILELLVLEQFLTILPEEFQPWVREHHPESGEEAVAVIENIQRELEERRQQIVACPDVLPRKMATPGAVQESCSPHPLTVDTQPEQAPQKPRLLEENALPVLQVPSLPLKDSQELTASLLSTGSQKLVKIEEVADVAVSFILEEWGHLDQSQKSLYRDDRKENYGSITSMGYESRDNMELIVKQISDDSESHWVAPEHTERSVPQDPDFAEVSDLKGMVQRWQVNPTVGKSRQNPSQKRDLDAITDISPKQSTHGERGHRCSDCGKFFLQASNFIQHRRIHTGEKPFKCGECGKSYNQRVHLTQHQRVHTGEKPYKCQVCGKAFRVSSHLVQHHSVHSGERPYGCNECGKNFGRHSHLIEHLKRHFREKSQRCSDKRSKNTKLSVKKKISEYSEADMELSGKTQRNVSQVQDFGEGCEFQGKLDRKQGIPMKEILGQPSSKRMNYSEVPYVHKKSSTGERPHKCNECGKSFIQSAHLIQHQRIHTGEKPFRCEECGKSYNQRVHLTQHQRVHTGEKPYTCPLCGKAFRVRSHLVQHQSVHSGERPFKCNECGKGFGRRSHLAGHLRLHSREKSHQCRECGEIFFQYVSLIEHQVLHMGQKNEKNGICEEAYSWNLTVIEDKKIELQEQPYQCDICGKAFGYSSDLIQHYRTHTAEKPYQCDICRENVGQCSHTKQHQKIYSSTKSHQCHECGRGFTLKSHLNQHQRIHTGEKPFQCKECGMNFSWSCSLFKHLRSHERTDPINTLSVEGSLL

SEQ ID NO: 755384 - protein, 837 aa, Homo sapiens; identical to SEQ ID NO: 755383

SEQ ID NO: 755385 - protein, 444 aa, Homo sapiens
MTESREVIDLDPPAETSQEQEDLFIVKVEEEDCTWMQEYNPPTFETFYQRFRHFQYHEASGPREALSQLRVLCCEWLRPELHTKEQILELLVLEQFLTILPEEFQPWVREHHPESGEEAVAVIENIQRELEERRQQIVACPDVLPRKMATPGAVQESCSPHPLTVDTQPEQAPQKPRLLEENGYESRDNMELIVKQISDDSESHWVAPEHTERSVPQDPDFAEVSDLKGMVQRWQVNPTVGKSRQNPSQKRDLDAITDISPKQSTHGERGHRCSDCGKFFLQASNFIQHRRIHTGEKPFKCGECGKSYNQRVHLTQHQRVHTGEKPYKCQVCGKAFRVSSHLVQHHSVHSGERPYGCNECGKNFGRHSHLIEHLKRHFREKSQRCSDKRSKNTKLSVKKKVMVRKRMEMKMRKLSQLRASGQLKMMRMTMSIPRSRRPTRMTRQ

SEQ ID NO: 755386 - protein, 764 aa, Homo sapiens
MTESREVIDLDPPAETSQEQEDLFIVKVEEEDCTWMQEYNPPTFETFYQRFRHFQYHEASGPREALSQLRVLCCEWLRPELHTKEQILELLVLEQFLTILPEEFQPWVREHHPESGEEAVAVIENIQRELEERRQQIVACPDVLPRKMATPGAVQESCSPHPLTVDTQPEQAPQKPRLLEENGYESRDNMELIVKQISDDSESHWVAPEHTERSVPQDPDFAEVSDLKGMVQRWQVNPTVGKSRQNPSQKRDLDAITDISPKQSTHGERGHRCSDCGKFFLQASNFIQHRRIHTGEKPFKCGECGKSYNQRVHLTQHQRVHTGEKPYKCQVCGKAFRVSSHLVQHHSVHSGERPYGCNECGKNFGRHSHLIEHLKRHFREKSQRCSDKRSKNTKLSVKKKISEYSEADMELSGKTQRNVSQVQDFGEGCEFQGKLDRKQGIPMKEILGQPSSKRMNYSEVPYVHKKSSTGERPHKCNECGKSFIQSAHLIQHQRIHTGEKPFRCEECGKSYNQRVHLTQHQRVHTGEKPYTCPLCGKAFRVRSHLVQHQSVHSGERPFKCNECGKGFGRRSHLAGHLRLHSREKSHQCRECGEIFFQYVSLIEHQVLHMGQKNEKNGICEEAYSWNLTVIEDKKIELQEQPYQCDICGKAFGYSSDLIQHYRTHTAEKPYQCDICRENVGQCSHTKQHQKIYSSTKSHQCHECGRGFTLKSHLNQHQRIHTGEKPFQCKECGMNFSWSCSLFKHLRSHERTDPINTLSVEGSLL

SEQ ID NO: 755387 - protein, 837 aa, Homo sapiens; identical to SEQ ID NO: 755383

SEQ ID NO: 755388 - protein, 764 aa, Homo sapiens; identical to SEQ ID NO: 755386

SEQ ID NO: 755389 - protein, 837 aa, Homo sapiens; identical to SEQ ID NO: 755383

SEQ ID NO: 755390 - protein, 764 aa, Homo sapiens; identical to SEQ ID NO: 755386

SEQ ID NO: 755391 - protein, 764 aa, Homo sapiens; identical to SEQ ID NO: 755386

SEQ ID NO: 755392 - protein, 203 aa, Homo sapiens
MHQIYSCSDENIEVFTTVIPSKVSSPARRRAKSSQHLLTKNVVIESDLYTHQPLELLPHRGDRRDPGDRRRFGRLQTARPPTAHPAKASARPVGISEPKTSNLCGNRAYGKSLIPPVPRISVKTSASASLEATAMGTEKGAVLMRGSRHLKKMTEEYPALPQGAEASLPLTGSASCGVPGILRKMWTRHKKKSEYVGSHQQRL

SEQ ID NO: 755393 - protein, 129 aa, Homo sapiens
MAAAARARVAYLLRQLQRAACQCPTHSHTYSQAPGLSPSGKTTDYAFEMAVSNIRYGAAVTKEVGMDLKNMGAKNVCLMTDKNLSKLPPVQVAMDSLVKNGIPFTVYDNVRVEPTDSRYSCIVVIVSLL

SEQ ID NO: 755394 - protein, 303 aa, Homo sapiens
MAAAARARVAYLLRQLQRAACQCPTHSHTYSQAPGLSPSGKTTDYAFEMAVSNIRYGAAVTKEVGMDLKNMGAKNVCLMTDKNLSKLPPVQVAMDSLVKNGIPFTVYDNVRVEPTDSSFMEAIEFAQKGAFDAYVAVGGGSTMDTCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVNSTDK

SEQ ID NO: 755395 - protein, 467 aa, Homo sapiens [sequence omitted]

SEQ ID NO: 755396 - protein, 255 aa, Homo sapiens
MAVSNIRYGAAVTKEVGMDLKNMGAKNVCLMTDKNLSKLPPVQVAMDSLVKNGIPFTVYDNVRVEPTDSSFMEAIEFAQKGAFDAYVAVGGGSTMDTCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVNSTDK

SEQ ID NO: 755397 - protein, 233 aa, Homo sapiens [sequence omitted]

SEQ ID NO: 755398 - protein, 119 aa, Homo sapiens
MWITHWCPMAFLWWLTSPAVFTFTAQMFPERHLEMAEILGADTRTARIQDAGLVLADTLRKFLFDLDVDDGLAAVGYSKADIPALVKGTLPQERVTKLAPRPQSEEDLAALFEASMKLY

SEQ ID NO: 755399 - protein, 237 aa, Homo sapiens
MAVSNIRYGAAVTKEVGMDLKNMGAKNVCLMTDKNLSKLPPVQVAMDSLVKNGIPFTVYDNVRVEPTDSSFMEAIEFAPCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVNSTDK

SEQ ID NO: 755400 - protein, 303 aa, Homo sapiens; identical to SEQ ID NO: 755394

SEQ ID NO: 755401 - protein, 158 aa, Homo sapiens [sequence omitted]

SEQ ID NO: 755402 - protein, 131 aa, Homo sapiens
MQGRTALSSAGHRISFLPSPMAFLWWLTSPAVFTFTAQMFPERHLEMAEILGADTRTARIQDAGLVLADTLRKFLFDLDVDDGLAAVGYSKADIPALVKGTLPQERVTKLAPRPQSEEDLAALFEASMKLY

SEQ ID NO: 755403 - protein, 303 aa, Homo sapiens; identical to SEQ ID NO: 755394

SEQ ID NO: 755404 - protein, 303 aa, Homo sapiens; identical to SEQ ID NO: 755394

SEQ ID NO: 755405 - protein, 303 aa, Homo sapiens; identical to SEQ ID NO: 755394

SEQ ID NO: 755406 - protein, 158 aa, Homo sapiens [sequence omitted]

SEQ ID NO: 755407 - protein, 131 aa, Homo sapiens; identical to SEQ ID NO: 755402

SEQ ID NO: 755408 - protein, 303 aa, Homo sapiens; identical to SEQ ID NO: 755394

SEQ ID NO: 755409 - protein, 303 aa, Homo sapiens; identical to SEQ ID NO: 755394

SEQ ID NO: 755410 - protein, 126 aa, Homo sapiens [sequence omitted]

SEQ ID NO: 755411 - protein, 126 aa, Homo sapiens [sequence omitted]

SEQ ID NO: 755412 - protein, 436 aa, Homo sapiens
RGEGAPGRTLSLVLSRCGRPRLLGRLSGMKTKFCTGGEAEPSPLGLPLPQPPPPQPPADEQPEPRTRRRAYLWCKEFLPGAWRGLREDEFHISVIRGGLSNMLFQCSLPDTTATLGDEPRKVLLRLYGAILQMRSCNKEGSEQAQKENEFQGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 755413 - protein, 281 aa, Homo sapiens
MVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 755414 - protein, 281 aa, Homo sapiens; identical to SEQ ID NO: 755413

SEQ ID NO: 755415 - protein, 230 aa, Homo sapiens
RPPTTTKFAAARTPFSKEPKWLGGTMQKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 755416 - protein, 109 aa, Homo sapiens [sequence omitted]

SEQ ID NO: 755417 - protein, 436 aa, Homo sapiens; identical to SEQ ID NO: 755412

SEQ ID NO: 755418 - protein, 484 aa, Homo sapiens
RGEGAPGRTLSLVLSRCGRPRLLGRLSGMKTKFCTGGEAEPSPLGLLLSCGSGSAAPAPGVGQQRDAASDLESKQLAPTAALALPPPPPLPLPLPLPQPPPPQPPADEQPEPRTRRRAYLWCKEFLPGAWRGLREDEFHISVIRGGLSNMLFQCSLPDTTATLGDEPRKVLLRLYGAILQMRSCNKEGSEQAQKENEFQGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 755419 - protein, 418 aa, Homo sapiens
RGEGAPGRTLSLVLSRCGRPRLLGRLSGMKTKFCTGGEAEPSPLGLPLPQPPPPQPPADEQPEPRTRRRAYLWCKEFLPGAWRGLREDEFHISVIRGGLSNMLFQCSLPDTTATLGDEPRKVLLRLYGAILQMGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 755420 - protein, 383 aa, Homo sapiens
QHIPAPQSPQLPLPQPPPPQPPADEQPEPRTRRRAYLWCKEFLPGAWRGLREDEFHISVIRGGLSNMLFQCSLPDTTATLGDEPRKVLLRLYGAILQMGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 755421 - protein, 355 aa, Homo sapiens
AVVGGAGSGGRGTVRGGLSNMLFQCSLPDTTATLGDEPRKVLLRLYGAILQMRSCNKEGSEQAQKENEFQGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 755422 - protein, 190 aa, Homo sapiens
TRRGRVGRPTRPRTRGLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 755423 - protein, 38 aa, Homo sapiens
CQEEQDAYRRIHSLTHLDSVTKIHNGSDIQNPDPAVYQ

SEQ ID NO: 755424 - protein, 37 aa, Homo sapiens
ESDAFLVCLNHALSTEKEEVMGLCIGEISRTLTLPCT

SEQ ID NO: 755425 - protein, 171 aa, Homo sapiens
LNRQAMRKETITKMLWSTRTLLNITKEQVPLVVEEYLDNVNEHDWKMLRNRMMDIVQDATFVYATLQTAHYHRDAGLPVYLYEFEHHARGIIVKPRTDGADHGDEMYFLFGGPFATGAKVPPDTPTGCPVSHLWMQTHPSIGWPQGAHQFLICYALPNESLLLRKQQKQQE

SEQ ID NO: 755426 - protein, 69 aa, Homo sapiens
VLLLTHEDGCGEGENPNDGNLPCWPRYNKDEKYLQLDFTTRVGMKLKEKKMAFWMSLYQSQRPEKQRQF

SEQ ID NO: 755427 - protein, 125 aa, Homo sapiens
MLRNRMMDIVQDATFVYATLQTAHYHRDAGLPVYLYEFEHHARGIIVKPRTDGADHGDEMYFLFGGPFATGAKVPPDTPTGCPVSHLWMQTHPSIGWPQGAHQFLICYALPNESLLLRKQQKQQE

SEQ ID NO: 755428 - protein, 108 aa, Homo sapiens
MLRNRMMDIVQDATFVYATLQTAHYHRDAGLPVYLYEFEHHARGIIVKPRTDGADHGDEMYFLFGGPFATGAKVPPDTPTGCPVSHLWMQTHPLQSLYTGVVSSIKKC

SEQ ID NO: 755429 - protein, 82 aa, Homo sapiens
DSPGCTIRHEKLPFSPSQAKNSWGAEHGSKSLVGPPLAQLAPRPQVSVASSLRISPRSRYHLWWRSTWTMSMSMTGRCYETV

SEQ ID NO: 755430 - protein, 150 aa, Homo sapiens
MLRNRMMDIVQDATFVYATLQTAHYHRDAGLPVYLYEFEHHARGIIVKPRTDGADHGDEMYFLFGGPFATGLSMGKEKALSLQMMKYWANFARTGNPNDGNLPCWPRYNKDEKYLQLDFTTRVGMKLKEKKMAFWMSLYQSQRPEKQRQF

SEQ ID NO: 755431 - protein, 348 aa, Homo sapiens
MSLPRFQRVNFGPYDNYIPVSELSKKSWNQQHFALLFPKPQRPGTKRRSKPSQIRDNTVSIIDEEQLRGDRRQPLWMYRSLMRISERPSVYLAARRQPLKPTRTVEVDSKAAEIGKKGEDKTTQKDTTDSESELKQGKKDSKKGKDIEKGKEEKLDAKKDSKKGKKDAEKGKDSATESEDEKGGAKKDNKKDKKDSNKGKDSATESEGEKGGTEKDSKKGKKDSKKGKDSAIELQAVKADEKKDEDGKKDANKGDESKDAKKDAKEIKKGKKDKKKPSSTDSDSKDDVKKESKKDATKDAKKVAKKDTEKESADSKKDAKKNAKKDAKKDAKKNAKKDEKKDAKKKGK

SEQ ID NO: 755432 - protein, 409 aa, Homo sapiens
MMMSLNSKQAFSMPHGGSLHVEPKYSALHSTSPGSSAPIAPSASSPSSSSNAGGGGGGGGGGGGGGGGRSSSSSSSGSSGGGGSEAMRRACLPTPPSNIFGGLDESLLARAEALAAVDIVSQSKSHHHHPPHHSPFKPDATYHTMNTIPCTSAASSSSVPISHPSALAGTHHHHHHHHHHHHQPHQALEGELLEHLSPGLALGAMAGPDGAVVSTPAHAPHMATMNPMHQAALSMAHAHGLPSHMGCMSDVDADPRDLEAFAERFKQRRIKLGVTQADVGSALANLKIPGVGSLSQSTICRFESLTLSHNNMIALKPILQAWLEEAEKSHREKLTKPELFNGAEKKRKRTSIAAPEKRSLEAYFAIQPRPSSEKIAAIAEKLDLKKNVVRVWFCNQRQKQKRMKYSAGI

SEQ ID NO: 755433 - protein, 223 aa, Homo sapiens
ERPAGAGVTGHSCTGQSTMASDHQTQAGKPQSLNPKIIIFEQENFQGHSHELNGPCPNLKETGVEKAGSVLVQAGPWVGYEQANCKGEQFVFEKGEYPRWDSWTSSRRTDSLSSLRPIKVDSQEHKIILYENPNFTGKKMEIIDDDVPSFHAHGYQEKVSSVRVQSGTWVGYQYPGYRGLQYLLEKGDYKDSSDFGAPHPQVQSVRRIRDMQWHQRGAFHPSN

SEQ ID NO: 755434 - protein, 240 aa, Homo sapiens
TGTSGEGINATSRWPSFTALAGAGVTGHSCTGQSTMASDHQTQAGKPQSLNPKIIIFEQENFQGHSHELNGPCPNLKETGVEKAGSVLVQAGPWVGYEQANCKGEQFVFEKGEYPRWDSWTSSRRTDSLSSLRPIKVDSQEHKIILYENPNFTGKKMEIIDDDVPSFHAHGYQEKVSSVRVQSGTWVGYQYPGYRGLQYLLEKGDYKDSSDFGAPHPQVQSVRRIRDMQWHQRGAFHPSN

SEQ ID NO: 755435 - protein, 328 aa, Homo sapiens
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGICHPLAPWHKRGGRRAAWLVCVAVWLAVTTQCLPTAIFAATGIQRNRTVCYDLSPPALATHYMPYGMALTVIGFLLPFAALLACYCLLACRLCRQDGPAEPVAQERRGKAARMAVVVAAAFAISFLPFHITKTAYLAVRSTPGVPCTVLEAFAAAYKGTRPFASANSVLDPILFYFTQKKFRRRPHELLQKLTAKWQRQGR

SEQ ID NO: 755436 - protein, 328 aa, Homo sapiens; identical to SEQ ID NO: 755435

SEQ ID NO: 755437 - protein, 328 aa, Homo sapiens; identical to SEQ ID NO: 755435

SEQ ID NO: 755438 - protein, 328 aa, Homo sapiens; identical to SEQ ID NO: 755435

SEQ ID NO: 755439 - protein, 328 aa, Homo sapiens; identical to SEQ ID NO: 755435

SEQ ID NO: 755440 - protein, 418 aa, Homo sapiens
MYGPGVNRPRAACQLCAVASYFLSPGLSVSSSAASPDFCQNIARDSFRHRTDWQQGLLHEWEFAPALHGLQARHLLTLGLPEHRKPTWAAMEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGICHPLAPWHKRGGRRAAWLVCVAVWLAVTTQCLPTAIFAATGIQRNRTVCYDLSPPALATHYMPYGMALTVIGFLLPFAALLACYCLLACRLCRQDGPAEPVAQERRGKAARMAVVVAAAFAISFLPFHITKTAYLAVRSTPGVPCTVLEAFAAAYKGTRPFASANSVLDPILFYFTQKKFRRRPHELLQKLTAKWQRQGR

SEQ ID NO: 755441 - protein, 160 aa, Homo sapiens
MAQRNRTVCYDLSPPALATHYMPYGMALTVIGFLLPFAALLACYCLLACRLCRQDGPAEPVAQERRGKAARMAVVVAAAFAISFLPFHITKTAYLAVRSTPGVPCTVLEAFAAAYKGTRPFASANSVLDPILFYFTQKKFRRRPHELLQKLTAKWQRQGR

SEQ ID NO: 755442 - protein, 328 aa, Homo sapiens; identical to SEQ ID NO: 755435

SEQ ID NO: 755443 - protein, 328 aa, Homo sapiens; identical to SEQ ID NO: 755435

SEQ ID NO: 755444 - protein, 328 aa, Homo sapiens; identical to SEQ ID NO: 755435

SEQ ID NO: 755445 - protein, 178 aa, Homo sapiens
QRHLVAECILNTRLAEGVSGALLPGLSSHSPLRFGGDGEPGRVRVNTHSLRVQLSRAFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTRSASCSTH

SEQ ID NO: 755446 - protein, 153 aa, Homo sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSLCLVASSDLQAAPPTEDK

SEQ ID NO: 755447 - protein, 224 aa, Homo sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREVTRVRSQGFVTLLFNVVTKDMRKLGYDTGPSDTQGVLGPSPPQSFPKSAAAHRPEGQPGGQSWGHTE

SEQ ID NO: 755448 - protein, 204 aa, Homo sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREVTRVRSQGFVTLLFNVVTKDMRKLGYDTGPSDTQGVLGPSPPQSFPQ

SEQ ID NO: 755449 - protein, 142 aa, Homo sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTRSASCSTH

SEQ ID NO: 755450 - protein, 240 aa, Homo sapiens
QRHLVAECILNTRLAEGVSGALLPGLSSHSPLRFGGDGEPGRVRVNTHSLRVQLSRAFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREVTRVRSQGFVTLLFNVVTKDMRKLGYDTGPSDTQGVLGPSPPQSFPQ

SEQ ID NO: 755451 - protein, 187 aa, Homo sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREDENAEAEIPRSTWVSLCPSPAWLMLPFCPQ

SEQ ID NO: 755452 - protein, 95 aa, Homo sapiens
WQLAKLLVLLLKLSSCFRSLGSHSCIFSLGKSCRPGPLPNPPARAVEPVATQPLPGQSLQGQLKASLPLLLQWNCPCYPQTDEGANTLIYTFNKL

SEQ ID NO: 755453 - protein, 120 aa, Homo sapiens
LPASIHPLMFVPVSLVLDRKDALLMLAMLVEPLWSFSDMHRVGKNIESPGIHVQLRLNQQSWNQGTTGNHILTLQMITHTPHGRSGKSSDAPAFQDNMMLLYIPWTMTSISVVEVGGLMA

SEQ ID NO: 755454 - protein, 131 aa, Homo sapiens
SIPSLSLQTQGTPAPFKKLALSDIFSITLASCGRGALGYSLTNHSWIGSKSATYGNICQFLSSALGLSQNGDLGKSHLASSSLLLAVLFCFCVCFLETGSYSVARLECGGVTIAHCSLKLLGSCNPPASAF

SEQ ID NO: 755455 - protein, 131 aa, Homo sapiens
TGTPGPGIGLGQKACSSHSLPFLCLWEQIRAAMVWVLSPATQEGAGTGAPSAPPLGSSVTQARGFLSLPPWLLRAAQAACMCLGQGPKKPLHGVWSLGLALPSPLPLPRLSPSEPGGGGVGILAFYLPCSR

SEQ ID NO: 755456 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 755457 - protein, 297 aa, Homo sapiens; identical to SEQ ID NO: 755456

SEQ ID NO: 755458 - protein, 447 aa, Homo sapiens
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 755459 - protein, 516 aa, Homo sapiens
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGGAGPREQNLGEAELWRATGPAGVGGTEMKVRVRRKLEMELSWERRSGGDWAGDWGDSPFSLTAHPLCSGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 755460 - protein, 381 aa, Homo sapiens
MSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 755461 - protein, 503 aa, Homo sapiens
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGGVRQPPHPHLPLSPPKALVDVGVFPGWQGGVCGSPTDACVVQVSKVTPSFLFPCLGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 755462 - protein, 97 aa, Homo sapiens
INSLGQNPSCVGGPRGRGEAAAGDPGALTHPLRSPVPRGCTFLVPTPCTAAPPASPVLSSADPAAYPRQSRNPGPQPCAQGTAGPSELTEVVPRRAR

SEQ ID NO: 755463 - protein, 85 aa, Homo sapiens
RGGLDIRADTVIDGGRKPMVPTLWLPWMQGQPSTLGSTSRVQTGQRVTGSGPGVKSSSSYGKTNMSTQSMLYNLFQFTSSHAYKI

SEQ ID NO: 755464 - protein, 327 aa, Homo sapiens
MQMPAMMSLLLVSVGLMEALQAQSHPITRRDLFSQEIQLDMALASFDDQYAGCAAAMTAALPDLNHTEFQANQVYADSWTLASSQWQERQARWPEWSLSPTRPSPPPLGFRDEHGVALLAYTANSPLHKEFNAAVREAGRSRAHYLHHFSFKTLHFLLTEALQLLGSGQRPPRCHQVFRGVHGLRFRPAGPRATVRLGGFASASLKHVAAQQFGEDTFFGIWTCLGAPIKGYSFFPGEEEVLIPPFETFQVINASRPAQGPARIYLRALGKHSTYNCEYIKDKKCKSGPCHLDNSAMGQSPLSAVWSLLLLLWFLVVRAFPDGPGLL

SEQ ID NO: 755465 - protein, 137 aa, Homo sapiens
NESGAVDSDLNPFLAPRQATADLLSSLEDLELSNRRLVGENAKLQRSMETAEEGSARLGEEILALRKQLHSTQQALQFAKAMDEELEDLKTLARSLEEQNRSLLAQARQAVGLAQGKEGALSLLCFLESGRQSVTME

SEQ ID NO: 755466 - protein, 276 aa, Homo sapiens
MDLPEGPVGGPTAEMYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSQQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAVGLAQGKEGALSLLCFLESGRQSVTME

SEQ ID NO: 755467 - protein, 276 aa, Homo sapiens; identical to SEQ ID NO: 755466

SEQ ID NO: 755468 - protein, 262 aa, Homo sapiens
MYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSQQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAVGLAQGKEGALSLLCFLESGRQSVTME

SEQ ID NO: 755469 - protein, 255 aa, Homo sapiens
GQLQWGAKPHPFDNRGLELEEETAFQGALTSQQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPD

SEQ ID NO: 755470 - protein, 353 aa, Homo sapiens
MDLPEGPVGGPTAEMYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSQQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPDE

SEQ ID NO: 755471 - protein, 63 aa, Homo sapiens
ETNVARNLRIHMTSEKHMHNMMLLQQNMKQIQHNLHLGLAPAEAELYQYYLAQNIGLTGMKLE

SEQ ID NO: 755472 - protein, 396 aa, Homo sapiens [sequence omitted]

SEQ ID NO: 755473 - protein, 113 aa, Homo sapiens
SMLPFIISLRFLFSSAGLIGFLFMLRALVAANFNTVYIYTAEVYPTTMRALGMGTSGSLCRIGAMVAPFISQVLMSASILGALCLFSSVCVVCAISAFTLPIETKGRALQQIK

SEQ ID NO: 755474 - protein, 100 aa, Homo sapiens
LGINFLGRRLSLSITMGCTALFFLLLNICTSSAGLIGFLFMLRALVAANFNTVYIYTAEVLMSASILGALCLFSSVCVVCAISAFTLPIETKGRALQQIK

SEQ ID NO: 755475 - protein, 201 aa, Homo sapiens
MGTETNYLCLSPPRNVPIITGSKDLQNVNITLRIIFQPVASQLPRIFTSIGEDYDEPVLTYITTEILKSVVARFDAGEVITQRELVSRQVSNDLTEQAATFGLILDDVSLTYLTFGKEFTEAVEAKQVAQQEAERARFVKEKAEQQKKAEQQKKVEQQKKAAVISAEGDSKATELIANSLATAGDGLMELCKLEAAEALGT

SEQ ID NO: 755476 - protein, 108 aa, Homo sapiens
LNLLILVPRKAWRKLSCRHPQWGICPIYFKSEANGRFSLMQGVELEDHTGAGVRSSCKKTSFSLVTWRNFCKSICHLLICHHTSYKKSIFCGLIGHQWASLERSWVCE

SEQ ID NO: 755477 - protein, 127 aa, Homo sapiens
MGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 755478 - protein, 127 aa, Homo sapiens; identical to SEQ ID NO: 755477

SEQ ID NO: 755479 - protein, 181 aa, Homo sapiens
GNTVLAAKVPGNQAAVQRIVQPSRPVKQLVLQPVKGSAPAGNPGATGPPLKPAVTLTSTPTQGESKRITLVLQQPQSGGPQGHRHVVLGSLPGKIVLQGNQLAALTQAKNAQGQPAKVVTIQLQVQQPQQKIQIVPQPPSSQPQPQQPPSTQPVTLSSVQQAQIMGPGQSPGQRLSVPVKV

SEQ ID NO: 755480 - protein, 156 aa, Homo sapiens
MADPIMDLFDDPNLFGLDSLTDDSFNQVTQDPIEEALGLPSSLDSLDQMNQDGGGGDVGNSSASELVPPPEETAPTELSKESTAPAPESITLHDYTTQPASQEQPAQPVLQTSTPTSGLLQVSKSQEILSQGNPFMGVSATAVSSSSAGGQPPQSA

SEQ ID NO: 755481 - protein, 121 aa, Homo sapiens
MKGESKRITLVLQQPQSGGPQGHRHVVLGSLPGKIVLQGNQLAALTQAKNAQGQPAKVVTIQLQVQQPQQKIQIVPQPPSSQPQPQQPPSTQPVTLSSVQQAQIMGPGQSPGQRLSVPVKV

SEQ ID NO: 755482 - protein, 2233 aa, Homo sapiens
PPPLSSLPMAALVLEDGSVLRGQPFGAAVSTAGEVVFQTGMVGYPEALTDPSYKAQILVLTYPLIGNYGIPPDEMDEFGLCKWFESSGIHVAALVVGECCPTPSHWSATRTLHEWLQQHGIPGLQGVDTRELTKKLREQGSLLGKLVQNGTEPSSLPFLDPNARPLVPEVSIKTPRVFNTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTTVETIELTEDRRAFAARMAEIGEHVAPSEAGNSLEQAQAAAERLGYPVLVRAAFAVGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 755483 - protein, 2071 aa, Homo sapiens
LPGRRLEESPVCVTTTYTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTTVETIELTEDRRAFAARMAEIGEHVAPSEAGNSLEQAQAAAERLGYPVLVRAAFAVGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 755484 - protein, 1025 aa, Homo sapiens
MHLIAEDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 755485 - protein, 924 aa, Homo sapiens
KAEVEAGVNRPRRISAVIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 755486 - protein, 2071 aa, Homo sapiens; identical to SEQ ID NO: 755483

SEQ ID NO: 755487 - protein, 770 aa, Homo sapiens
MTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 755488 - protein, 2071 aa, Homo sapiens; identical to SEQ ID NO: 755483

SEQ ID NO: 755489 - protein, 1718 aa, Homo sapiens
LPGRRLEESPVCVTTTYTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTTVETIELTEDRRAFAARMAEIGEHVAPSEAGNSLEQAQAAAERLGYPVLVRAAFAVGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAVFLRPGA

SEQ ID NO: 755490 - protein, 1693 aa, Homo sapiens
LPGRRLEESPVCVTTTYTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTTVETIELTEDRRAFAARMAEIGEHVAPSEAGNSLEQAQAAAERLGYPVLVRAAFAVGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTPGVVVHICNPSYLGG

SEQ ID NO: 755491 - protein, 1238 aa, Homo sapiens
LPGRRLEESPVCVTTTYTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTTVETIELTEDRRAFAARMAEIGEHVAPSEAGNSLEQAQAAAERLGYPVLVRAAFAVGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVQELWQPTPLLPFPKGVKILHQRIIWAGHGGIYL

SEQ ID NO: 755492 - protein, 2101 aa, Homo sapiens
LPGRRLEESPVCVTTTYTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTTVETIELTEDRRAFAARMAEIGEHVAPSEAGNSLEQAQAAAERLGYPVLVRAAFAVGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLEVGWDLVGYPEAGGCLGESVNNSAKLPASCESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 755493 - protein, 2152 aa, Homo sapiens
MPGRRLEESPVCVTTTYTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTTVETIELTEDRRAFAARMAEIGEHVAPSEAGNSLEQAQAAAERLGYPVLVRAAFAVGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEVRVHLRSCCPCCFPSNTKGQVVLRGRRQQEESLETAGGGSRASTLAGLHHHFFEQGCWPLGLCVGQGIWVVPLLDLPIVPQILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 755494 - protein, 2071 aa, Homo sapiens; identical to SEQ ID NO: 755483

SEQ ID NO: 755495 - protein, 345 aa, Homo sapiens
PRVRGRVGCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 755496 - protein, 1684 aa, Homo sapiens
LPGRRLEESPVCVTTTYTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTTVETIELTEDRRAFAARMAEIGEHVAPSEAGNSLEQAQAAAERLGYPVLVRAAFAVGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTVSTLLG

SEQ ID NO: 755497 - protein, 1166 aa, Homo sapiens
LPGRRLEESPVCVTTTYTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTTVETIELTEDRRAFAARMAEIGEHVAPSEAGNSLEQAQAAAERLGYPVLVRAAFAVGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKKPTLPTP

SEQ ID NO: 755498 - protein, 427 aa, Homo sapiens
GEGRSGLPPVHKDNLCLPCGGFYEGGDSRLSLVCFLDAFKRGQLEDINCGNSPEPSSDGISPSCAAVAPSLEEIRNQKSVTVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 755499 - protein, 501 aa, Homo sapiens
APARRGLGDRCSSSSFSSSFFSSASSPRRLATAAARAGGAAVIPVPEEPALPVPGGRGAGEAGPRRTQQVEPGVPGRAPPAHHAALCHLSRPQAKILSMMEDNKQLALRIDGAVQSASQEVTNLRAELTATNRRLAELSGGGGPGPGPGAAASASAAGDSAATNMENPQLGAQVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRRKQRKSLDPGLFDGTAPDYYIEEDADW

SEQ ID NO: 755500 - protein, 519 aa, Homo sapiens
APARRGLGDRCSSSSFSSSFFSSASSPRRLATAAARAGGAAVIPVPEEPALPVPGGRGAGEAGPRRTQQVEPGVPGRAPPAHHAALCHLSRPQAKILSMMEDNKQLALRIDGAVQSASQEVTNLRAELTATNRRLAELSGGGGPGPGPGAAASASAAGDSAATNMENPQLGAQVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 755501 - protein, 415 aa, Homo sapiens
MRAADSGSWERVRQLAAQGEPAPSCGAGAGPARPPGPAACEQCVDAAGPGDRPRAGVPRVRADGDCSQPVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 755502 - protein, 430 aa, Homo sapiens
HQQLSASVDGGLMGARPLAGAFYLSSGIGTAALGDEYYCDLHSPHKDREVTCQGQTTTQGQSQDLNQAIQFQNHCSSLSFGHFTVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 755503 - protein, 986 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 755504 - protein, 968 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDSVQAMRTQMQQMHGRMVPV

SEQ ID NO: 755505 - protein, 833 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDT

SEQ ID NO: 755506 - protein, 949 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQE

SEQ ID NO: 755507 - protein, 116 aa, Homo sapiens
MASTVVAVGLTIAAAGFAGRYVLQAMKHMEPQVKQVFQSLPKSAFSGGYYRGGFEPKMTKREAALILGVSPTANKGKIRDAHRRIMLLNHPDKGGSPYIAAKINEAKDLLEGQAKK

SEQ ID NO: 755508 - protein, 116 aa, Homo sapiens; identical to SEQ ID NO: 755507

SEQ ID NO: 755509 - protein, 78 aa, Homo sapiens
FVVTGKPAGLWKQGSPAGAMASTVVAVGLTIAAAGFAGRYVLQAMKHMEPQVKQVFQSLPKSAFSGGYYRALLPIKGK

SEQ ID NO: 755510 - protein, 116 aa, Homo sapiens; identical to SEQ ID NO: 755507

SEQ ID NO: 755511 - protein, 116 aa, Homo sapiens; identical to SEQ ID NO: 755507

SEQ ID NO: 755512 - protein, 135 aa, Homo sapiens
CVTGKNLACSGKQGSPAGAMASTVVAVGLTIAAAGFAGRYVLQAMKHMEPQVKQVFQSLPKSAFSGGYYRGGFEPKMTKREAALILGVSPTANKGKIRDAHRRIMLLNHPDKGGSPYIAAKINEAKDLLEGQAKK

SEQ ID NO: 755513 - protein, 256 aa, Homo sapiens
EVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVATDEADDGPFSHDGCQPMAIAMYSSSQPCHLSGY

SEQ ID NO: 755514 - protein, 210 aa, Homo sapiens
ATALLAGIIDPDAIRREEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVATDEADDGPFSHDGCQPMAIAMYSSSQPCHLSGY

SEQ ID NO: 755515 - protein, 273 aa, Homo sapiens
EVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMV

SEQ ID NO: 755516 - protein, 166 aa, Homo sapiens
EVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLAQSLVNSGRLQVDNMESSQQR

SEQ ID NO: 755517 - protein, 116 aa, Homo sapiens
MVPETWGLKKHEDLFTAKGTFPCREIRRERKSPIVYQKKKSLGAFKEEWLHDGNERHRLKDSLRESPRAAEEQGSSPTYIPPYGRAYLSGASKGRTAIQANVVGVKLSRSWVKNKD

SEQ ID NO: 755518 - protein, 72 aa, Homo sapiens
MVKVEPVENQCPTSPSYRGQHILANSNNSNPCSASQASQLEPLTPVGSDIMSFVVGTEQAVACSLPQSPEYI

SEQ ID NO: 755519 - protein, 66 aa, Homo sapiens
TAGAAQRRIVGPSEGRRGLGVAGAMGTLRLRQVDSAVWVTWAESRAWRQRVGGEEVFLVFFFQSQK

SEQ ID NO: 755520 - protein, 104 aa, Homo sapiens
GQLTLTQRSSGSGNNSSSAFSTMSLRLDTTPSCNSARPLHALQVLLLLSLLLTALASSTKGQTKRNLAKGKEESLDSDLYAELRCMCIKTTSGIQLPKTSKVWK

SEQ ID NO: 755521 - protein, 104 aa, Homo sapiens; identical to SEQ ID NO: 755520

SEQ ID NO: 755522 - protein, 104 aa, Homo sapiens; identical to SEQ ID NO: 755520

SEQ ID NO: 755523 - protein, 126 aa, Homo sapiens
YFHQSPDPPHHTQLPPPYQGTEVFPMLGSVLRDPSFFSNPQDFNPQHFLNDKGQFKKSDAFVPFSIGKRNCFGEGLARMELFLFFTTVMQNFRLKSSQSPKDIDVSPKHVVFATIPRNYTMSFLPR

SEQ ID NO: 755524 - protein, 494 aa, Homo sapiens
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVFPMLGSVLRDPSFFSNPQDFNPQHFLNDKGQFKKSDAFVPFSIGKRNCFGEGLARMELFLFFTTVMQNFRLKSSQSPKDIDVSPKHVVFATIPRNYTMSFLPR

SEQ ID NO: 755525 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVGTLSGTIFFILLIIFLSWIILKHRKGNNAHENPKEVAIHLHSQGGSSVHPRTLQTNEENSRVLP

SEQ ID NO: 755526 - protein, 1986 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVAQKKAIMHMKT

SEQ ID NO: 755527 - protein, 2486 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVGTLSGTIFFILLIIFLSWIILKHRKGNNAHENPKEVAIHLHSQGGSSVHPRTLQTNEENSRVLP

SEQ ID NO: 755528 - protein, 238 aa, Homo sapiens
MDEQSQGMQGPPVPQFQPQKALRPDMGYNTLANFRIEKKIGRGQFSEVYRAACLLDGVPVALKKVQIFDLMDAKARADCIKEIDLLKQLNHPNVIKYYASFIEDNELNIVLELADAGDLSRMIKHFKKQKRLIPERTVWKYFVQLCSALEHMHSRRVMHRDIKPANVFITATGVVKLGDLGLGRFFSSKTTAAHSLLVRLITCLQREYMKNGYNFESDIWSLGCLLYEMGAFTKSFQW

SEQ ID NO: 755529 - protein, 236 aa, Homo sapiens
MDEQSQGMQGPPVPQFQPQKALRPDMGYNTLANFRIEKKIGRGQFSEVYRAACLLDGVPVALKKVQIFDLMDAKARADCIKEIDLLKQLNHPNVIKYYASFIEDNELNIVLELADAGDLSRMIKHFKKQKRLIPERTVWKYFVQLCSALEHMHSRRVMHRDIKPANVFITATGVVKLGDLGLGRFFSSKTTAAHSLVGTPYYMSPERIHEMAALQSPFYGDQMDLYLLRKKFEQCD

SEQ ID NO: 755530 - protein, 236 aa, Homo sapiens
MDEQSQGMQGPPVPQFQPQKALRPDMGYNTLANFRIEKKIGRGQFSEVYRAACLLDGVPVALKKVQIFDLMDAKARADCIKEIDLLKQLNHPNVIKYYASFIEDNELNIVLELADAGDLSRMIKHFKKQKRLIPERTVWKYFVQLCSALEHMHSRRVMHRDIKPANVFITATGVVKLGDLGLGRFFSSKTTAAHSLLVRLITCLQREYMSMAALQSPFYGDQMDLYLLRKKFEQCD

SEQ ID NO: 755531 - protein, 436 aa, Homo sapiens
MAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 755532 - protein, 436 aa, Homo sapiens; identical to SEQ ID NO: 755531

SEQ ID NO: 755533 - protein, 190 aa, Homo sapiens
MKHLFPVLQSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 755534 - protein, 207 aa, Homo sapiens
MYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLGE

SEQ ID NO: 755535 - protein, 165 aa, Homo sapiens
SKTNDPPAEIRTMPSARASSPPLSLGRRWQATSAPRGWRAPDGAVGNRVPVPAPGATLRTTSYAETGPGVHPAAALQHTGLRGNFSSALWRLLGFRPGWGYGMKAAIGPESACCSAGGLSHPYPGHRPGGPFTPCLASLSSRSLEAQGLQQHQEGLRFSGPEDRH

SEQ ID NO: 755536 - protein, 255 aa, Homo sapiens
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 755537 - protein, 255 aa, Homo sapiens; identical to SEQ ID NO: 755536

SEQ ID NO: 755538 - protein, 480 aa, Homo sapiens [sequence omitted]

SEQ ID NO: 755539 - protein, 458 aa, Homo sapiens
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNMLKAQNDRETQSLDVIFTERQAKEKQIRSVEEEIEQEKQATDDIIKNMSFENQVKYLEMKTTNEKLLQELDTLQQQLDSQNMKKESLEAEIAHSQVKQEAVLLHEKLYELESHRDQMIAEDKSIGSPMEEREKLLKQIKDDNQEIASMERQLTDTKEKINQFIEEIRQLDMDLEEHQGEMNQKYKELKKREEHMDTFIETFEETKNQELKRKAQIEANIVALLEHCSRNINRIEQISSITNQELKMMQDDLNFKSTEVQKSQSTAQNLTSDIQRLRLSAAGVPS

SEQ ID NO: 755540 - protein, 264 aa, Homo sapiens
MRITLYSDMDLEEHQGEMNQKYKELKKREEHMDTFIETFEETKNQELKRKAQIEANIVALLEHCSRNINRIEQISSITNQELKMMQDDLNFKSTEVQKSQSTAQNLTSDIQRLQLDLQKMELLESKMTEEQHSLKSKIKQMTTDLEIYNDLPALKSSGEEKIKKLHQERMILSTHRNAFKKIMEKQNIEYEALKTQLQENETHSQLTNLERKWQHLEQNNFAMKEFIATKSQESDYQPIKKNVTKQIAEYNKTIVDALHSTSGN

SEQ ID NO: 755541 - protein, 129 aa, Homo sapiens
LLLLNKRPVDEIYNDLPALKSSGEEKIKKLHQERMILSTHRNAFKKIMEKQNIEYEALKTQLQENETHSQLTNLERKWQHLEQNNFAMKEFIATKSQESDYQPIKKNVTKQIAEYNKTIVDALHSTSGN

SEQ ID NO: 755542 - protein, 152 aa, Homo sapiens
DAWVDPRVRIDKRTIEKFEKEAAEMGKGSFKYAWVLDKLKAELNVVSPLISKLHQERMILSTHRNAFKKIMEKQNIEYEALKTQLQENETHSQLTNLERKWQHLEQNNFAMKEFIATKSQESDYQPIKKNVTKQIAEYNKTIVDALHSTSGN

SEQ ID NO: 755543 - protein, 600 aa, Homo sapiens
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNMLKAQNDRETQSLDVIFTERQAKEKQIRSVEEEIEQEKQATDDIIKNMSFENQVKYLEMKTTNEKLLQELDTLQQQLDSQNMKKESLEAEIAHSQVKQEAVLLHEKLYELESHRDQMIAEDKSIGSPMEEREKLLKQIKDDNQEIASMERQLTDTKEKINQFIEEIRQLDMDLEEHQGEMNQKYKELKKREEHMDTFIETFEETKNQELKRKAQIEANIVALLEHCSRNINRIEQISSITNQELKMMQDDLNFKSTEVQKSQSTAQNLTSDIQRLQLDLQKMELLESKMTEEQHSLKSKIKQMTTDLEIYNDLPALKSSGEEKIKKLHQERMILSTHRNAFKKIMEKQNIEYEALKTQLQENETHSQLTNLERKWQHLEQNNFAMKEFIATKSQESDYQPIKKNVTKQIAEYNKTIVDALHSTSGN

SEQ ID NO: 755544 - protein, 372 aa, Homo sapiens
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNMLKAQNDRETQSLDVIFTERQAKEKQIRSVEEEIEQEKQATDDIIKNMSFENQVKYLEMKTTNEKLLQELDTLQQQLDSQNMKKESLEAEIAHSQVKQEAVLLHEKLYELESHRDQMIAEDKSIGSPMEEREKLLKQIKDDNQEIASMERQLTDTKEKINQFIEEIRQLDMDLEEHQDPTNYGWKILEKNTGSFKKQV

SEQ ID NO: 755545 - protein, 169 aa, Homo sapiens
FMEGGNKTVQIDLDIQRLQLDLQKMELLESKMTEEQHSLKSKIKQMTTDLEIYNDLPALKSSGEEKIKKLHQERMILSTHRNAFKKIMEKQNIEYEALKTQLQENETHSQLTNLERKWQHLEQNNFAMKEFIATKSQESDYQPIKKNVTKQIAEYNKTIVDALHSTSGN

SEQ ID NO: 755546 - protein, 165 aa, Homo sapiens
MLLSKSPSSLSANISSSPKGSPSSSRKSGTSCPSSKNSSPNSSPRTLGRSKGRLWLPQIGSKNKLSSSKKNLDASKENGAGQICELADALSRGHMRGVGSQPELVTPQDHEVALANGFLYEHEAYGNGYSNGQLGNHSEEDSTDDQREDTHIKPIYMQFHAIQEF

SEQ ID NO: 755547 - protein, 165 aa, Homo sapiens; identical to SEQ ID NO: 755546

SEQ ID NO: 755548 - protein, 165 aa, Homo sapiens; identical to SEQ ID NO: 755546

SEQ ID NO: 755549 - protein, 353 aa, Homo sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRESAARGPTIL

SEQ ID NO: 755550 - protein, 369 aa, Homo sapiens
PGCQCEVEHGRVVWAPLTASSSSRGHGMVGAGSRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRESAARGPTIL

SEQ ID NO: 755551 - protein, 353 aa, Homo sapiens; identical to SEQ ID NO: 755549

SEQ ID NO: 755552 - protein, 353 aa, Homo sapiens; identical to SEQ ID NO: 755549

SEQ ID NO: 755553 - protein, 353 aa, Homo sapiens; identical to SEQ ID NO: 755549

SEQ ID NO: 755554 - protein, 470 aa, Homo sapiens
MNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECRCLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 755555 - protein, 426 aa, Homo sapiens
MNFLFLKIYLLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECRCLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 755556 - protein, 484 aa, Homo sapiens
MVMQFQGLENPIQISPHCSCTPSGFFMEMMSMKPAKGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECRCLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 755557 - protein, 470 aa, Homo sapiens; identical to SEQ ID NO: 755554

SEQ ID NO: 755558 - protein, 395 aa, Homo sapiens
MNFLFLKIYLLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 755559 - protein, 122 aa, Homo sapiens
MNFLFLKIYLLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGKHL

SEQ ID NO: 755560 - protein, 474 aa, Homo sapiens
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 755561 - protein, 115 aa, Homo sapiens
MDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 755562 - protein, 512 aa, Homo sapiens
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKIFYKDIKQNGTQYRSLWDPTGNLSPTRRTTNYDFSLYTMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 755563 - protein, 75 aa, Homo sapiens
NFQKWAAVVVPSGEEQRYMCHVQHEGLPKPLTLRWKQSSQPTIPIVGYRCWPGSPWSCSHWSCGFCCDVQEEELR

SEQ ID NO: 755564 - protein, 812 aa, Homo sapiens
MEPLGNWRSLRAPLPPMLLLLLLQVAGPVGALAETLLNAPRAMGTSSSPPSPASVVAPGTTLFEESRLPVFTLDYPHVQIPFEITLWILLASLAKIGFHLYHKLPTIVPESCLLIMVGLLLGGIIFGVDEKSPPAMKTDVFFLYLLPPIVLDAGYFMPTRPFFENIGTIFWYAVVGTLWNSIGIGVSLFGICQIEAFGLSDITLLQNLLFGSLISAVDPVAVLAVFENIHVNEQLYILVFGESLLNDAVTVVLYNLFKSFCQMKTIETIDVFAGIANFFVVGIGGVLIGIFLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLMWRALGVFVLTQVINRFRTIPLTFKDQFIIAYGGLRGAICFALVFLLPAAVFPRKKLFITAAIVVIFFTVFILGITIRPLVEFLDVKRSNKKQQAVSEEIYCRLFDHVKTGIEDVCGHWGHNFWRDKFKKFDDKYLRKLLIRENQPKSSIVSLYKKLEIKHAIEMAETGMISTVPTFASLNDCREEKIRKVTSSETDEIRELLSRNLYQIRQRTLSYNRHSLTADTSERQAKEILIRRRHSLRESIRKDSSLNREHRASTSTSRYLSLPKNTKLPEKLQKRRTISIADGNSSDSDADAGTTVLNLQPRARRFLPEQFSKKSPQSYKMEWKNEVDVDSGRDMPSTPPTPHSREKGTQTSGLLQQPLLSKDQSGSEREDSLTEGIPPKPPPRLVWRASEPGSRKARFGSEKP

SEQ ID NO: 755565 - protein, 697 aa, Homo sapiens
MVGLLLGGIIFGVDEKSPPAMKTDVFFLYLLPPIVLDAGYFMPTRPFFENIGTIFWYAVVGTLWNSIGIGVSLFGICQIEAFGLSDITLLQNLLFGSLISAVDPVAVLAVFENIHVNEQLYILVFGESLLNDAVTVVLYNLFKSFCQMKTIETIDVFAGIANFFVVGIGGVLIGIFLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLMWRALGVFVLTQVINRFRTIPLTFKDQFIIAYGGLRGAICFALVFLLPAAVFPRKKLFITAAIVVIFFTVFILGITIRPLVEFLDVKRSNKKQQAVSEEIYCRLFDHVKTGIEDVCGHWGHNFWRDKFKKFDDKYLRKLLIRENQPKSSIVSLYKKLEIKHAIEMAETGMISTVPTFASLNDCREEKIRKVTSSETDEIRELLSRNLYQIRQRTLSYNRHSLTADTSERQAKEILIRRRHSLRESIRKDSSLNREHRASTSTSRYLSLPKNTKLPEKLQKRRTISIADGNSSDSDADAGTTVLNLQPRARRFLPEQFSKKSPQSYKMEWKNEVDVDSGRDMPSTPPTPHSREKGTQTSGLLQQPLLSKDQSGSEREDSLTEGIPPKPPPRLVWRASEPGSRKARFGSEKP

SEQ ID NO: 755566 - protein, 265 aa, Homo sapiens
MSEQQMDLKDLMPTKRKYMWKTAEDRRMSDLTCVLEWLERRQGKKKQAPEKQKPKVVTVLKRNKKKEEKKGKGLMTARGGNRRDTETSQQALGKRFRKDAASYRSLYGVEQKGKHLSMVPGSYIKDGPKKSDTDIKDAVDPESTQRPNPFRRQSIVLDPMLQEGTFNSQRATFIRDWSNKMPDMAYERKLKSLMEKSTEPKMETMRMLKPEEVLSCRYLRLSKENIRTLLKLCKDAGMNVDIHPHMVEEDIDAKKVFTGIPSMAL

SEQ ID NO: 755567 - protein, 120 aa, Homo sapiens
WGCPREGSYSRNSHTPNNHQCTNHSMLFGTRQEMLQAGVRSWQKWAVGEMELLQPFSVPALTAPTKSSRAGWAETSIPAGLSLGGGAGAKEPPWVGASGAGAGPEDCSPCMEGRPGWSPG

SEQ ID NO: 755568 - protein, 188 aa, Homo sapiens
EWVDVVVDDLLPIKDGKLVFVHSAEGNEFWSALLEKAYAKLSSGCGGNSSFQLPLGVGAHDCLLRGSCLMPECCPGAAHRVNGSYEALSGGSTSEGFEDFTGGVTEWYELRKAPSDLYQIILKALGRGSLLGCSIDISSVLDMEAITFKKLVKGHAYSVTGAKQVLPWVGPSLKGGSCPLACPCLSGT

SEQ ID NO: 755569 - protein, 188 aa, Homo sapiens; identical to SEQ ID NO: 755568

SEQ ID NO: 755570 - protein, 103 aa, Homo sapiens
FFYQDQNSHFNFSARMVLMASTLPESKLQTPHNTTAYKEYLGPGVDTFSSAKLFQKLYCLSRWWYLLTSYPTQGSGLSAGIQGILQGSLLVYTSPVSAPSSGA

SEQ ID NO: 755571 - protein, 150 aa, Homo sapiens [sequence omitted]

SEQ ID NO: 755572 - protein, 148 aa, Homo sapiens
QLATAGQPAADSLERGSQETARHPGKPLFAPLTLSSLFRPPSGAPNPPRHARLGRMVRFGVWAGRVPGPLGGRRREEGKRFGHGGGCALTRAVPGRLQVEYHKKYGKIFRMKLGSFESVHLGSPCLLEALYRTESAYPQRLEIKPWKA

SEQ ID NO: 755573 - protein, 85 aa, Homo sapiens
IFYILSFGLKLQNQVCLPCLQHSSVWIGSISSDRRYTCVAAMWDSELQATLAFIFHPGLLTSNFRLAALSSHCGPIPVSWGPVGF

SEQ ID NO: 755574 - protein, 80 aa, Homo sapiens
RFNCLYSAVAVAGSPWGGKWRRGDGCQVEKSKDKLDPMRMISMCCRRNGCPLSLSSATAFRMLKKDPGRGKALAGPPTTL

SEQ ID NO: 755575 - protein, 296 aa, Homo sapiens
MNALCVKNSSYVHSSLHRHIISHSGNNPYGCEECGKKPCTCKQCQKTSLSVTRVHRDTVMHTGNGHYGCTICEKVFNIPSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 755576 - protein, 248 aa, Homo sapiens
MQETFRNLASIGNKGEDQSIEDQYKNSSRNLSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 755577 - protein, 117 aa, Homo sapiens
MSGHPGSWEMNSVAFEDVAVNFTQEEWALLDPSQKNLYRDVMQETFRNLASIGNKGEDQSIEDQYTLVSFGSMYVPFFLCTLGARNCHVIDRRIVHFKLVQNFYVLFLLKQTKTGYV

SEQ ID NO: 755578 - protein, 135 aa, Homo sapiens
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTDSAGESP

SEQ ID NO: 755579 - protein, 259 aa, Homo sapiens
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTDSAEPEMDVRKRTGVAGSQPVSEKQSAAELDLVLQRHQNLQEKLAEEMLGLARSLKTNTLAAQSVIKKDNQTLSHSLKMADQNLEKLKTESERLEQHTQKSVNWLLWAMLIIVCFIFISMILFIRIMPKLK

SEQ ID NO: 755580 - protein, 128 aa, Homo sapiens
ASEKASQHRSIVAGALRDEEEFRRRQKWHSQQRAQHQQATRGAGQSQGSRERPFLAPVLLTPFPPPPQTLSHSLKMADQNLEKLKTESERLEQHTQKSVNWLLWAMLIIVCFIFISMILFIRIMPKLK

SEQ ID NO: 755581 - protein, 259 aa, Homo sapiens; identical to SEQ ID NO: 755579

SEQ ID NO: 755582 - protein, 146 aa, Homo sapiens
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTDSAEPEMDVRKRTPCHTH

SEQ ID NO: 755583 - protein, 146 aa, Homo sapiens; identical to SEQ ID NO: 755582

SEQ ID NO: 755584 - protein, 214 aa, Homo sapiens
LEVPDVFQQMRELGLARRVPDSLFRSLLERYLTAATASVGSGVPVLSRVPLKQKQPGLDYFYPQLQLGVTEAVVITQVCHPHRIHCQLRSVSQEIHRLSESMAQVYRGSTGTGDENSTSATWEEREESPDKPGSPCASCGLDGHWYRALLLETFRPQRCAQVLHVDYGRKELVSCSSLRYLLPEYFRMPVVTYPCALYGLWDGGRGWSRSQVGD

SEQ ID NO: 755585 - protein, 449 aa, Homo sapiens
MEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISVKKEDVNLMMSSGQILGIRFLDKLCSQKRDVSSPDENNGQSKSKYCLKINRPIGDAADTQDDDVEEIGDQDDSPSDDTVEGTPPSQEDGKSPTTTLRVQEAILKELGSEEVRKVNCYGQEVESMETPESKDLGSQTPQALTFNDGMSEVKDEQTPGWTTAASDMKFEYLLYGHHREQIACQACGKTFSDEGRLRKHEKLHTADRPFVCEMCTKGFTTQAHLKEHLKIHTGYKPYSCEVCGKSFIRAPDLKKHERVHSNERPFACHMCDKAFKHKSHLKDHERRHRGEKPFVCGSCTKAFAKASDLKRHENNMHSERKQVTPSAIQSETEQLQAAAMAAEAEQQLETIACS

SEQ ID NO: 755586 - protein, 449 aa, Homo sapiens; identical to SEQ ID NO: 755585

SEQ ID NO: 755587 - protein, 415 aa, Homo sapiens
MEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISDENNGQSKSKYCLKINRPIGDAADTQDDDVEEIGDQDDSPSDDTVEGTPPSQEDGKSPTTTLRVQEAILKELGSEEVRKVNCYGQEVESMETPESKDLGSQTPQALTFNDGMSEVKDEQTPGWTTAASDMKFEYLLYGHHREQIACQACGKTFSDEGRLRKHEKLHTADRPFVCEMCTKGFTTQAHLKEHLKIHTGYKPYSCEVCGKSFIRAPDLKKHERVHSNERPFACHMCDKAFKHKSHLKDHERRHRGEKPFVCGSCTKAFAKASDLKRHENNMHSERKQVTPSAIQSETEQLQAAAMAAEAEQQLETIACS

SEQ ID NO: 755588 - protein, 449 aa, Homo sapiens; identical to SEQ ID NO: 755585

SEQ ID NO: 755589 - protein, 449 aa, Homo sapiens; identical to SEQ ID NO: 755585

SEQ ID NO: 755590 - protein, 449 aa, Homo sapiens; identical to SEQ ID NO: 755585

SEQ ID NO: 755591 - protein, 143 aa, Homo sapiens
MEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISVKKEDVNLMMSSGQILGIRFLDKLCSQKRDVSSPDENNGQSKSN

SEQ ID NO: 755592 - protein, 100 aa, Homo sapiens
LAADWLGQRRNHRGLMLSSCQLNGFRVEPQERGCLCRWSHRFQVEPWVSDMQKTWKGISKVRSTAVVVFAGVTGGSCISYNLRNTCLHLSRTQAPLLPSA

SEQ ID NO: 755593 - protein, 369 aa, Homo sapiens
SLCKATAVPAGLWQAPGSMAVKLGTLLLALALGLAQPASARRKLLVFLLDGFRSDYISDEALESLPGFKEIVSRGVKVDYLTPDFPSLSYPNYYTLMTGRHCEVHQMIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGKHSEIYNKLSTVEHMTVYEKEAIPSRFYYKKGKFVSPLTLVADEGWFITEVIMKYVPIYSLCKFYKTVQS

SEQ ID NO: 755594 - protein, 34 aa, Homo sapiens
MNLSLEPQTHRYKLLMDVSVWMHHKHPNMPQMAF

SEQ ID NO: 755595 - protein, 407 aa, Homo sapiens
LPLASRTELARGTPPSTALHSLRDKGEARGAEGAVMAELEAVADDLDALIDDLDYLPGHFHLEMQLNFEPRSPAPQRARDLKLQREGLRQELQLAAAPQRPAVRHLLGAFAFYLEELDEARECFLEVAHEHPGNLNAWANLAHVYGRLGQEEEEEACAARLADLMGLAEEPEAAGDPQLRAARCLAEQGYAHGFDVGCASPEERARGLAAGIALYDKALGYGQQIPMEEKRGWYFTMATLYIRLDGIFLELGSEEQKRLPAFNRTLALLRQVLKSEDPRHRALAWCYLGMLLERKDTFSTTPMGVHDCGYSGTDPLDCFGKAIEIAKNQPPILNRLAKIFYFLGKQDMAIGTCNMALDVLRDPELNWQAYCTRAKRRGLTMLPRLVSNSWAQAVLPPRPPKVLEFQV

SEQ ID NO: 755596 - protein, 140 aa, Homo sapiens
MAIGTCNMALDVLRDPELNWQAYCTRAKIHIRAYLHDLKRAKMGLGGMPDRNHLACAKADLEEVVRVCPGFKAYLDIGQVYYYMGVDAVQELLAVDEAALNQALVFLAKAGESELGATLPELQLLRGKCLRIKGEDANAA

SEQ ID NO: 755597 - protein, 487 aa, Homo sapiens
LPLASRTELARGTPPSTALHSLRDKGEARGAEGAVMAELEAVADDLDALIDDLDYLPGHFHLEMQLNFEPRSPAPQRARDLKLQREGLRQELQLAAAPQRPAVRHLLGAFAFYLEELDEARECFLEVAHEHPGNLNAWANLAHVYGRLGQEEEEEACAARLADLMGLAEEPEAAGDPQLRAARCLAEQGYAHGFDVGCASPEERARGLAAGIALYDKALGYGQQIPMEEKRGWYFTMATLYIRLDGIFLELGSEEQKRLPAFNRTLALLRQVLKSEDPRHRALAWCYLGMLLERKDTFSTTPMGVHDCGYSGTDPLDCFGKAIEIAKNQPPILNRLAKIFYFLGKQDMAIGTCNMALDVLRDPELNWQAYCTRAKIHIRAYLHDLKRAKMGLGGMPDRNHLACAKADLEEVVRVCPGFKAYLDIGQVYYYMGVDAVQELLAVDEAALNQALVFLAKAGESELGATLPELQLLRGKCLRIKGEDANAA

SEQ ID NO: 755598 - protein, 424 aa, Homo sapiens
LPLASRTELARGTPPSTALHSLRDKGEARGAEGAVMAELEAVADDLDALIDDLDYLPGHFHLEMQLNFEPRSPAPQRARDLKLQREGLRQELQLAAAPQRPAVRHLLGAFAFYLEELDEARECFLEVAHEHPGNLNAWANLAHVYGRLGQEEEEEACAARLADLMGLAEEPEAAGDPQLRAARCLAEQGYAHGFDVGCASPEERARGLAAGIALYDKALGYGQQIPMEEKRGWYFTMATLYIRLDGIFLELGSEEQKRLPAFNRTLALLRQVLKSEDPRHRALAWCYLGMLLERKDTFSTTPMGVHDCGYSGTDPLDCFGKAIEIAKNQPPILNRLAKIFYFLGKQDMAIGTCNMALDVLRDPELNWQAYCTRAKLPALVPDLPPRAHTEPMCLRKPTRSSQFTSLQAEESSHPLIFSTTIHMT

SEQ ID NO: 755599 - protein, 81 aa, Homo sapiens
FLVVAHPFHLNNKARFPPSPSFLMVAHPAYLTNKARFPPSPSFLMVVHPVGFHSHGSSALKSVSEEVLMILTLLTRDKMSH

SEQ ID NO: 755600 - protein, 86 aa, Homo sapiens
FLVVAHPFHLNNKARFPPSPSFLMVAHPAYLTNKARFPPSPSFLMVVHPVGFHSHGSSALKSVSEEVLMAAVSPPASDCHLWGPEK

SEQ ID NO: 755601 - protein, 96 aa, Homo sapiens
FDATILKGFTARTSPKFLALSSGPYPAEEAATAAAGGEEEKEASPAEANAALRLSAKKFPAPMSPRRASPTIPRRAWGTGPSADDRCRFALGSRMW

SEQ ID NO: 755602 - protein, 127 aa, Homo sapiens
MRRCLECTGPRDPLDPAEGGWRRDGQAVGSVMVRCPVFSLPRPLQIAAVLPLGVGCGERMGLLPYGAHNGQRRFREVSALPALRPQSALLESSHSTSKRSFKDGLVERPSFVSEEIKCRLSDLPKIR

SEQ ID NO: 755603 - protein, 305 aa, Homo sapiens
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELMVPVQWSDMVTLKARMTNYGLPRYRWLTHAWNFFQREFKCCGVVYFTDWLEMTEMDWPPDSCCVREFPGCSKQAHQEDLSDLYQEGCGKKMYSFLRGTKQLQVLRFLGISIGVTQILAMILTITLLWALYYDRREPGTDQMMSLKNDNSQHLSCPSVELLKPSLSRIFEHTSMANSFNTHFEMEEL

SEQ ID NO: 755604 - protein, 305 aa, Homo sapiens; identical to SEQ ID NO: 755603

SEQ ID NO: 755605 - protein, 305 aa, Homo sapiens; identical to SEQ ID NO: 755603

SEQ ID NO: 755606 - protein, 875 aa, Homo sapiens
PAASAAQSAPARPCWNPGLSRSRSGADMTTAPQEPPARPLQAGSGAGPAPGRAMRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPVYGQDPWPGLSRASFLLSPACLACLTKEPSFHETEVWGGGYSCLSASSLAPALPSLPSISRPPQGFLCRCPGRVYPSQHLTTVPQSLHQEMKTVCTAAGVTLPDASGCGIAFLGPPWGHLWPPVTPRPRVPGHPGRSSLGPLRPASLPGGDCVGSGVGISRDGLRVSSLCTHIGGWGAGRERQGRENGISRGGLSFELSQRERPCPAPFLERCLPSRLEACGVWVRWGRTMEEKPSKVSLKSSDRQGSDEESVHSDTRDLWTTTTLSQAQLNMPLSEVCEGFDEEGRNISKTRGWHSPGRGSLDEGYKASHKPEELDEHALVELELHRGSSMEINLGEKDTASQIEAEKSSSMSSLNIAKHMPHRAYWAEQQSRLPLPLMELMENEALEILTKALRSYQLGIGRDHFLTKELQRYIEGLKKRRSKRLYVN

SEQ ID NO: 755607 - protein, 393 aa, Homo sapiens
MRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 755608 - protein, 822 aa, Homo sapiens
MRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPVYGQDPWPGLSRASFLLSPACLACLTKEPSFHETEVWGGGYSCLSASSLAPALPSLPSISRPPQGFLCRCPGRVYPSQHLTTVPQSLHQEMKTVCTAAGVTLPDASGCGIAFLGPPWGHLWPPVTPRPRVPGHPGRSSLGPLRPASLPGGDCVGSGVGISRDGLRVSSLCTHIGGWGAGRERQGRENGISRGGLSFELSQRERPCPAPFLERCLPSRLEACGVWVRWGRTMEEKPSKVSLKSSDRQGSDEESVHSDTRDLWTTTTLSQAQLNMPLSEVCEGFDEEGRNISKTRGWHSPGRGSLDEGYKASHKPEELDEHALVELELHRGSSMEINLGEKDTASQIEAEKSSSMSSLNIAKHMPHRAYWAEQQSRLPLPLMELMENEALEILTKALRSYQLGIGRDHFLTKELQRYIEGLKKRRSKRLYVN

SEQ ID NO: 755609 - protein, 1088 aa, Homo sapiens
PAASAAQSAPARPCWNPGLSRSRSGADSKCGAGSGARAGLRGRDAPGATGRAGCPPLARGRLREWCGRRSRRPPRSEASLCGRGGGGGSELRALRGGPAVWRVHASVHTRVRGLWVPWRGRHAHGGRGCRGVCGECRWVTTAPQEPPARPLQAGSGAGPAPGRAMRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGGGGDWHVGGGKELPHGGRCRETEGSQVAPRLPASPLCPGYGNVALRTDAGRLFCIFYALVGIPLFGILLAGVGDRLGSSLRHGIGHIEAIFLVSCSMPCLPLLLGSGYPSPCPWHMSAPPKTISLSHRLPGGGSGEYGSGDCWCLLGRAYCPIPQKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPVYGQDPWPGLSRASFLLSPACLACLTKEPSFHETEVWGGGYSCLSASSLAPALPSLPSISRPPQGFLCRCPGRVYPSQHLTTVPQSLHQEMKTVCTAAGVTLPDASGCGIAFLGPPWGHLWPPVTPRPRVPGHPGRSSLGPLRPASLPGGDCVGSGVGISRDGLRVSSLCTHIGGWGAGRERQGRENGISRGGLSFELSQRERPCPAPFLERCLPSRLEACGVWVRWGRTMEEKPSKVSLKSSDRQGSDEESVHSDTRDLWTTTTLSQAQLNMPLSEVCEGFDEEGRNISKTRGWHSPGRGSLDEGYKASHKPEELDEHALVELELHRGSSMEINLGEKDTASQIEAEKSSSMSSLNIAKHMPHRAYWAEQQSRLPLPLMELMENEALEILTKALRSYQLGIGRDHFLTKELQRYIEGLKKRRSKRLYVN

SEQ ID NO: 755610 - protein, 888 aa, Homo sapiens
LPPPRPSRHRRGRAGTRASAAAAAGPTEVADALGGGADPETNSTSNSSHSAWDLGSAFFFSGTIITTIGGGGDWHVGGGKELPHGGRCRETEGSQVAPRLPASPLCPGYGNVALRTDAGRLFCIFYALVGIPLFGILLAGVGDRLGSSLRHGIGHIEAIFLVSCSMPCLPLLLGSGYPSPCPWHMSAPPKTISLSHRLPGGGSGEYGSGDCWCLLGRAYCPIPQKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPVYGQDPWPGLSRASFLLSPACLACLTKEPSFHETEVWGGGYSCLSASSLAPALPSLPSISRPPQGFLCRCPGRVYPSQHLTTVPQSLHQEMKTVCTAAGVTLPDASGCGIAFLGPPWGHLWPPVTPRPRVPGHPGRSSLGPLRPASLPGGDCVGSGVGISRDGLRVSSLCTHIGGWGAGRERQGRENGISRGGLSFELSQRERPCPAPFLERCLPSRLEACGVWVRWGRTMEEKPSKVSLKSSDRQGSDEESVHSDTRDLWTTTTLSQAQLNMPLSEVCEGFDEEGRNISKTRGWHSPGRGSLDEGYKASHKPEELDEHALVELELHRGSSMEINLGEKDTASQIEAEKSSSMSSLNIAKHMPHRAYWAEQQSRLPLPLMELMENEALEILTKALRSYQLGIGRDHFLTKELQRYIEGLKKRRSKRLYVN

SEQ ID NO: 755611 - protein, 1107 aa, Homo sapiens
HGSENQKLGQGAPWRDSRGAGRGPKPGVGAGGAPAATPPEVGPNLHVGQFQVAPPGFPHPFVPRSPSLMSAEPKGQAVPRGGELRALPDPVMGLGDARLAWCLSGETGQLMPRSGPCRWPHWAPVQGKKAGPCCNPSPAPLPPTSRGWPAVGSQAAAVTTAPQEPPARPLQAGSGAGPAPGRAMRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGGGGDWHVGGGKELPHGGRCRETEGSQVAPRLPASPLCPGYGNVALRTDAGRLFCIFYALVGIPLFGILLAGVGDRLGSSLRHGIGHIEAIFLVSCSMPCLPLLLGSGYPSPCPWHMSAPPKTISLSHRLPGGGSGEYGSGDCWCLLGRAYCPIPQKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPVYGQDPWPGLSRASFLLSPACLACLTKEPSFHETEVWGGGYSCLSASSLAPALPSLPSISRPPQGFLCRCPGRVYPSQHLTTVPQSLHQYMKTVCTAAGVTLPDASGCGIAFLGPPWGHLWPPVTPRPRVPGHPGRSSLGPLRPASLPGGDCVGSGVGISRDGLRVSSLCTHIGGWGAGRERQGRENGISRGGLSFELSQRERPCPAPFLERCLPSRLEACGVWVRWGRTMEEKPSKVSLKSSDRQGSDEESVHSDTRDLWTTTTLSQAQLNMPLSEVCEGFDEEGRNISKTRGWHSPGRGSLDEGYKASHKPEELDEHALVELELHRGSSMEINLGEKDTASQIEAEKSSSMSSLNIAKHMPHRAYWAEQQSRLPLPLMELMENEALEILTKALRSYQLGIGRDHFLTKELQRYIEGLKKRRSKRLYVN

SEQ ID NO: 755612 - protein, 263 aa, Homo sapiens
RPLTLSAPTHPWSDSGPWRYFLLSLGCPQPPPNPTFYGIPNPARLSSPARSSFPLQPSATLGSLLVCGPQVSLKSSDRQGSDEESVHSDTRDLWTTTTLSQAQLNMPLSEVCEGFDEEGRNISKTRGWHSPGRGSLDEGYKASHKPEELDEHALVELELHRGSSMEINLGEKDTASQIEAEKSSSMSSLNIAKHMPHRAYWAEQQSRLPLPLMELMENEALEILTKALRSYQLGIGRDHFLTKELQRYIEGLKKRRSKRLYVN

SEQ ID NO: 755613 - protein, 393 aa, Homo sapiens; identical to SEQ ID NO: 755607

SEQ ID NO: 755614 - protein, 159 aa, Homo sapiens
LSPSSPAAPALCSASEETMARPLCTLLLLMATLAGALASSSKEENRIIPGGIYDADLNDEWVQRALHFAISEYNKATKDDYYRRPLRVLRARQQTVGGVNYFFDVEVGRTICTKSQPNLDTCAFHEQPELQKKQLCSFEIYEVPWENRRSLVKSRCQES

SEQ ID NO: 755615 - protein, 159 aa, Homo sapiens; identical to SEQ ID NO: 755614

SEQ ID NO: 755616 - protein, 159 aa, Homo sapiens; identical to SEQ ID NO: 755614

SEQ ID NO: 755617 - protein, 52 aa, Homo sapiens
LPCYLQYDYSVLKIIASYKHTTSIFDDFSHYEKRQEEEESVKKVTHFFLLRF

SEQ ID NO: 755618 - protein, 579 aa, Homo sapiens
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQEEEESVKKERQGRGK

SEQ ID NO: 755619 - protein, 579 aa, Homo sapiens; identical to SEQ ID NO: 755618

SEQ ID NO: 755620 - protein, 579 aa, Homo sapiens; identical to SEQ ID NO: 755618

SEQ ID NO: 755621 - protein, 529 aa, Homo sapiens
MSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQEEEESVKKERQGRGK

SEQ ID NO: 755622 - protein, 529 aa, Homo sapiens; identical to SEQ ID NO: 755621

SEQ ID NO: 755623 - protein, 529 aa, Homo sapiens; identical to SEQ ID NO: 755621

SEQ ID NO: 755624 - protein, 265 aa, Homo sapiens
MPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQEEEESVKKERQGRGK

SEQ ID NO: 755625 - protein, 388 aa, Homo sapiens
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVADLYSDKACEGLCTGERYELII

SEQ ID NO: 755626 - protein, 579 aa, Homo sapiens; identical to SEQ ID NO: 755618

SEQ ID NO: 755627 - protein, 579 aa, Homo sapiens; identical to SEQ ID NO: 755618

SEQ ID NO: 755628 - protein, 579 aa, Homo sapiens; identical to SEQ ID NO: 755618

SEQ ID NO: 755629 - protein, 481 aa, Homo sapiens
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLLPLGVSHSVRSHQKWKWCACSWL

SEQ ID NO: 755630 - protein, 87 aa, Homo sapiens
HIRLENNENKPVTNSRRMCRIGYGNNENKPVTNSRDTQEVPLEKAKQVLKIIASYKHTTSIFDDFSHYEKRQEEEESVKKERQGRGK

SEQ ID NO: 755631 - protein, 199 aa, Homo sapiens
PLRVQASAEVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMLECHDVILGHCKLCLPGSKPGFTVLARMV

SEQ ID NO: 755632 - protein, 107 aa, Homo sapiens
MKVTTKVNRHDKINGKRKTAKEHLRKLSMKEREHGEKERQVSEAEENGKLDMKEIHTYMEMFQRAQALRRRAEDYYRCKITPSGKKASLQPGQNGGSGSIRHSSGLA

SEQ ID NO: 755633 - protein, 369 aa, Homo sapiens
LNPLSVDTVAVGLVSSVVVYPVYLAILFLFRMSRSKVAGSPSPTPAGQQVLDVDSCLDSSVLDSSFLTFSGLHAEVEGSTGGPAALAQLGLKTLCTSQQAFAGQMKSDLFLDDSKRLMDGWLHGCDGDGLLSGTFRILLMFCCLGYEWLSGGCKTWHSAWVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSGKKASLQPGQNGGSGSIRHSSGLA

SEQ ID NO: 755634 - protein, 354 aa, Homo sapiens
LNPLSVDTVAVGLVSSVVVYPVYLAILFLFRMSRSKVAGSPSPTPAGQQVLDVDSCLDSSVLDSSFLTFSGLHAEVEGSTGGPAALAQLGLKTLCTSQQAFAGQMKSDLFLDDSKRVTLRNPGSSGRKEHPEAGTGSWLGRTRNQVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSGKKASLQPGQNGGSGSIRHSSGLA

SEQ ID NO: 755635 - protein, 1133 aa, Homo sapiens
AAGPKPGSASATSSRGPQGTAQGCQPPGPVICLQGNWGVRKLGTHINMANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 755636 - protein, 1086 aa, Homo sapiens
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 755637 - protein, 1086 aa, Homo sapiens; identical to SEQ ID NO: 755636

SEQ ID NO: 755638 - protein, 1086 aa, Homo sapiens; identical to SEQ ID NO: 755636

SEQ ID NO: 755639 - protein, 1086 aa, Homo sapiens; identical to SEQ ID NO: 755636

SEQ ID NO: 755640 - protein, 1086 aa, Homo sapiens; identical to SEQ ID NO: 755636

SEQ ID NO: 755641 - protein, 1086 aa, Homo sapiens; identical to SEQ ID NO: 755636

SEQ ID NO: 755642 - protein, 464 aa, Homo sapiens [sequence omitted]

SEQ ID NO: 755643 - protein, 712 aa, Homo sapiens
MGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRY

SEQ ID NO: 755644 - protein, 438 aa, Homo sapiens
MGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLLVSTCGLLPSCELQFLNIYF

SEQ ID NO: 755645 - protein, 1086 aa, Homo sapiens; identical to SEQ ID NO: 755636

SEQ ID NO: 755646 - protein, 838 aa, Homo sapiens [sequence omitted]

SEQ ID NO: 755647 - protein, 955 aa, Homo sapiens
MVNPTLGVHEADLLKTSGTLISFIYPAQNPELLNKLSQRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 755648 - protein, 440 aa, Homo sapiens
MGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIDW

SEQ ID NO: 755649 - protein, 357 aa, Homo sapiens
MAAAAKPNNLSLVVHGPGDLRLENYPIPEPGPNEVLLRMHSVGICGSDVHYWEYGRIGNFIVKKPMVLGHEASGTVEKVGSSVKHLKPGDRVAIEPGAPRENDEFCKMGRYNLSPSIFFCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGQLGCKPEVTIECTGAEASIQAGIYATRSGGTLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 755650 - protein, 357 aa, Homo sapiens; identical to SEQ ID NO: 755649

SEQ ID NO: 755651 - protein, 357 aa, Homo sapiens; identical to SEQ ID NO: 755649

SEQ ID NO: 755652 - protein, 336 aa, Homo sapiens
MENYPIPEPGPNEVLLRMHSVGICGSDVHYWEYGRIGNFIVKKPMVLGHEASGTVEKVGSSVKHLKPGDRVAIEPGAPRENDEFCKMGRYNLSPSIFFCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGQLGCKPEVTIECTGAEASIQAGIYATRSGGTLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 755653 - protein, 357 aa, Homo sapiens; identical to SEQ ID NO: 755649

SEQ ID NO: 755654 - protein, 257 aa, Homo sapiens
LIINDLCVIVISYNLSNFFCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGQLGCKPEVTIECTGAEASIQAGIYATRSGGTLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 755655 - protein, 357 aa, Homo sapiens; identical to SEQ ID NO: 755649

SEQ ID NO: 755656 - protein, 339 aa, Homo sapiens
MAAAAKPNNLSLVVHGPGDLRLENYPIPEPGPNEVLLRMHSVGICGSDVHYWEYGRIGNFIVKKPMVLGHEASGTVEKVGSSVKHLKPGDRVAIEPGAPRVCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGQLGCKPEVTIECTGAEASIQAGIYATRSGGTLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 755657 - protein, 221 aa, Homo sapiens
MAAAAKPNNLSLVVHGPGDLRLENYPIPEPGPNEVLLRMHSVGICGSDVHYWEYGRIGNFIVKKPMVLGHEASGTVEKVGSSVKHLKPGDRVAIEPGAPRVCATPPDDGNLCRFYKHNAAFCYKLPDNVTFEEGALIEPLSVGIHACRRGGVTLGHKVLVCGAGPIGMVTLLVAKAMGAAQVVVTDCLLPVGPRPGYWGCFSPSEFPGKALRKLRRKVDWH

SEQ ID NO: 755658 - protein, 78 aa, Homo sapiens
DWAVPAPETMPFPVTTQGSQQTQPPQKHYGITSPISLAAPKETDCVLTQKLIETLKPFGVFEEEEKLQLQDFNFGKTK

SEQ ID NO: 755659 - protein, 142 aa, Homo sapiens
MSSAPIRTSSGISGVRSAASFFGSRRRGVVPGRCLGYRCSRRTWLGLPYESAQLDGECTAGEGGTRRPRAEFGTRPLSMNWNTSRQVQLHDSLFRETLPTGIPIVYELDKNLKPIKPMQFLGDEETVRKAMEAVAAQGKAKK

SEQ ID NO: 755660 - protein, 264 aa, Homo sapiens
QSVPHPQPAAMAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 755661 - protein, 217 aa, Homo sapiens
QSVPHPQPAAMAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSSGALSSIWRVSLKRLSWS

SEQ ID NO: 755662 - protein, 60 aa, Homo sapiens
MSLSRVLATVFGVSLPHQDPCFLLLPELSLLVRTEIPLKLLALVTAGFRFRRELSESVLL

SEQ ID NO: 755663 - protein, 326 aa, Homo sapiens
MSRYEAGLLHEYTAGREADDIVNWLKKRTGPAATTLPDGAAAESLVESSEVAVIGFFKNAGSPDICQAASSPGSQQAHRMHTTNFARPTFPNQGARCFLPTTTQTSHPNACAAQVPSFLQRKRFLHVHTAARANPPPFRTSGEADGSDPTRGYRQPGWPLWQPLVARPETSSHANSLRTHPLAPPQVIELPKSRAKEDMTKTPETAVPAWLTQRAGSARAHSSPKILARHRAVTTRGFSHNRNLSARNSAHPVPRNRATFDPSSGPRNGAANNPRSSAPPARQKRAKRPSDLRASPRTRNTHSQYAQTTSMTHHPHTPRTGPHRTH

SEQ ID NO: 755664 - protein, 166 aa, Homo sapiens
LLEDPRSPFHPEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTTVHAFPPDGAGAGSGKSSGPHASLGASLEGAWG

SEQ ID NO: 755665 - protein, 109 aa, Homo sapiens
GCCDFPRPGRPGPRGCAPSSNAQSGPSFCPHLMKAGTTLKGTVTKENLLDFIKHNQLPLVIEFTEQTAPKIFGGEIKTHILLFLPKSVSDYDGKLSNFKTAAESFKGKR

SEQ ID NO: 755666 - protein, 180 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKAVFAGSRGHR

SEQ ID NO: 755667 - protein, 180 aa, Homo sapiens; identical to SEQ ID NO: 755666

SEQ ID NO: 755668 - protein, 329 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 755669 - protein, 329 aa, Homo sapiens; identical to SEQ ID NO: 755668

SEQ ID NO: 755670 - protein, 329 aa, Homo sapiens; identical to SEQ ID NO: 755668

SEQ ID NO: 755671 - protein, 329 aa, Homo sapiens; identical to SEQ ID NO: 755668

SEQ ID NO: 755672 - protein, 329 aa, Homo sapiens; identical to SEQ ID NO: 755668

SEQ ID NO: 755673 - protein, 329 aa, Homo sapiens; identical to SEQ ID NO: 755668

SEQ ID NO: 755674 - protein, 309 aa, Homo sapiens
MTYHLGSLPTVTCSPNTSSTKMGLSSLRSLMKAGTTLKGTVTKENLLDFIKHNQLPLVIEFTEQSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 755675 - protein, 319 aa, Homo sapiens
DLEDALPGQIDKMGCSLEDLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 755676 - protein, 371 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFCKCCPFSSPGRAPGHAQGRQTPGEASASGFVSRTHPRTAFFSDAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 755677 - protein, 329 aa, Homo sapiens; identical to SEQ ID NO: 755668

SEQ ID NO: 755678 - protein, 252 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYRSRGPGRSRGARHGGRR

SEQ ID NO: 755679 - protein, 329 aa, Homo sapiens; identical to SEQ ID NO: 755668

SEQ ID NO: 755680 - protein, 329 aa, Homo sapiens; identical to SEQ ID NO: 755668

SEQ ID NO: 755681 - protein, 372 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFCKCCPFSSPGRAPGHAQGRQTPGEASASGFVSRTHPRTAFFSDAPWCGHCKQLAPIWDKLGETYKDHENIVIAKMDSTANEVEAVKVHSFPTLKFFPASADRTRVIDYNGERTLDGFKKFLESGGQDGAGDDDDLEDLEEAEEPDMEEDDDQKAVKDEL

SEQ ID NO: 755682 - protein, 343 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEACPPCGRDGAGLDMVTQYRLQCRHD

SEQ ID NO: 755683 - protein, 276 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKSPPWWGLFPETMMYFFIHESVQSACYRVRSLAASLPREVSPLFENSVCGIFRHFSTSGYLFHLGQASSEKLVPRVGGTEPDWTWSLSTACSVAMTDHGSCIFG

SEQ ID NO: 755684 - protein, 349 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDIPTDLGHNAEEHRLDGITHDPTSGYSEPAIHKATRREQTRGGPTQR

SEQ ID NO: 755685 - protein, 307 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTTVHAFPPDGAGAGSGKSSGPHASLGASLEGAWG

SEQ ID NO: 755686 - protein, 289 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTTALITTGNARCGKGD

SEQ ID NO: 755687 - protein, 241 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFSLFLFHLQISPCLLLFPVIHLCAVLSSH

SEQ ID NO: 755688 - protein, 180 aa, Homo sapiens; identical to SEQ ID NO: 755666

SEQ ID NO: 755689 - protein, 180 aa, Homo sapiens; identical to SEQ ID NO: 755666

SEQ ID NO: 755690 - protein, 180 aa, Homo sapiens; identical to SEQ ID NO: 755666

SEQ ID NO: 755691 - protein, 180 aa, Homo sapiens; identical to SEQ ID NO: 755666

SEQ ID NO: 755692 - protein, 180 aa, Homo sapiens; identical to SEQ ID NO: 755666

SEQ ID NO: 755693 - protein, 128 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTGVAVALPLNCL

SEQ ID NO: 755694 - protein, 329 aa, Homo sapiens; identical to SEQ ID NO: 755668

SEQ ID NO: 755695 - protein, 464 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTGRGVGLCQGSFCRQQRPSMTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 755696 - protein, 329 aa, Homo sapiens; identical to SEQ ID NO: 755668

SEQ ID NO: 755697 - protein, 299 aa, Homo sapiens
MKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 755698 - protein, 329 aa, Homo sapiens; identical to SEQ ID NO: 755668

SEQ ID NO: 755699 - protein, 329 aa, Homo sapiens; identical to SEQ ID NO: 755668

SEQ ID NO: 755700 - protein, 329 aa, Homo sapiens; identical to SEQ ID NO: 755668

SEQ ID NO: 755701 - protein, 329 aa, Homo sapiens; identical to SEQ ID NO: 755668

SEQ ID NO: 755702 - protein, 329 aa, Homo sapiens; identical to SEQ ID NO: 755668

SEQ ID NO: 755703 - protein, 331 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEAGHGHSVPPAVSP

SEQ ID NO: 755704 - protein, 342 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEACGLFKAEPRPLTPGWGGGQGCWS

SEQ ID NO: 755705 - protein, 274 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRT

SEQ ID NO: 755706 - protein, 285 aa, Homo sapiens
MTYHLGSLPTVTCSPNTSSTKMGLSSLRSLMKAGTTLKGTVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTRMEGATVISRE

SEQ ID NO: 755707 - protein, 180 aa, Homo sapiens; identical to SEQ ID NO: 755666

SEQ ID NO: 755708 - protein, 180 aa, Homo sapiens; identical to SEQ ID NO: 755666

SEQ ID NO: 755709 - protein, 180 aa, Homo sapiens; identical to SEQ ID NO: 755666

SEQ ID NO: 755710 - protein, 180 aa, Homo sapiens; identical to SEQ ID NO: 755666

SEQ ID NO: 755711 - protein, 401 aa, Homo sapiens
MPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGYLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 755712 - protein, 401 aa, Homo sapiens; identical to SEQ ID NO: 755711

SEQ ID NO: 755713 - protein, 401 aa, Homo sapiens; identical to SEQ ID NO: 755711

SEQ ID NO: 755714 - protein, 549 aa, Homo sapiens
PSLVAFTPLNASHPKRSAGPTFQRNAVEDGPHVPVRTLAPLQPAASRPLLQRAGAGRKKKTQKNNKKKTQKNTNHSSQQPSRRPRAAAEQRLPGTRAQRRGERARGGSRPPSSVPAVSPAKPSQAQPSPADRGHRSQPRSGSRLSVTLMPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGYLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 755715 - protein, 237 aa, Homo sapiens
MELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGYLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 755716 - protein, 401 aa, Homo sapiens; identical to SEQ ID NO: 755711

SEQ ID NO: 755717 - protein, 401 aa, Homo sapiens; identical to SEQ ID NO: 755711

SEQ ID NO: 755718 - protein, 78 aa, Homo sapiens
YEKEGVFLFGLDVFGIPMLQEPNPEEVETPLLHICLLQARHCSRSQDTEVETETNKPITVYNTLTSGGDKGQGPRDGG

SEQ ID NO: 755719 - protein, 141 aa, Homo sapiens
PSLVAFTPLNASHPKRSAGPTFQRNAVEDGPHVPVRTLAPLQPAASRPLLQRAGAGRKKKTQKNNKKKTQKNTNHSSQQPSRRPRAAAEQRLPGTRAQRRGERARGGSRPPSSVPAVSPAKPSQAQPSPADRGHRSQPRSG

SEQ ID NO: 755720 - protein, 401 aa, Homo sapiens; identical to SEQ ID NO: 755711

SEQ ID NO: 755721 - protein, 269 aa, Homo sapiens
TREDEPRLGTRLGWWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGYLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 755722 - protein, 401 aa, Homo sapiens; identical to SEQ ID NO: 755711

SEQ ID NO: 755723 - protein, 401 aa, Homo sapiens; identical to SEQ ID NO: 755711

SEQ ID NO: 755724 - protein, 401 aa, Homo sapiens; identical to SEQ ID NO: 755711

SEQ ID NO: 755725 - protein, 91 aa, Homo sapiens
PGSWLPDGGKLLGESAGEMPDTALLASDIKDILIFLVFKNYGKYTKDEIYHLKYFYVYDSVALNTLTVLCSHHHHPSPELSSSCNLKLCVR

SEQ ID NO: 755726 - protein, 295 aa, Homo sapiens [sequence omitted]

SEQ ID NO: 755727 - protein, 295 aa, Homo sapiens [sequence omitted]

SEQ ID NO: 755728 - protein, 295 aa, Homo sapiens [sequence omitted]

SEQ ID NO: 755729 - protein, 295 aa, Homo sapiens [sequence omitted]

SEQ ID NO: 755730 - protein, 324 aa, Homo sapiens
DPRAAGIRHPQSATAGEEGTRPGSQELRNMELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFMVQHTSFKEMKKNPMTNYTTVPQEFMDHSISPFMRKGMAGDWKTTFTVAQNERFDADYAEKMAGCSLSFRSEL

SEQ ID NO: 755731 - protein, 295 aa, Homo sapiens [sequence omitted]

SEQ ID NO: 755732 - protein, 295 aa, Homo sapiens [sequence omitted]

SEQ ID NO: 755733 - protein, 295 aa, Homo sapiens [sequence omitted]

SEQ ID NO: 755734 - protein, 295 aa, Homo sapiens [sequence omitted]

SEQ ID NO: 755735 - protein, 295 aa, Homo sapiens [sequence omitted]

SEQ ID NO: 755736 - protein, 295 aa, Homo sapiens [sequence omitted]

SEQ ID NO: 755737 - protein, 295 aa, Homo sapiens [sequence omitted]

SEQ ID NO: 755738 - protein, 295 aa, Homo sapiens [sequence omitted]

SEQ ID NO: 755739 - protein, 295 aa, Homo sapiens [sequence omitted]

SEQ ID NO: 755740 - protein, 217 aa, Homo sapiens [sequence omitted]

SEQ ID NO: 755741 - protein, 469 aa, Homo sapiens
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKEVDHVRCFPPCDSWGQAPHRDPPRPPSPLPGQPPQQDQIPHPAFLAQASPLRPHLAAGPTQLSSLAPESAAWGATDQKLSPIATPCQRVCHPGPQSQKKTITVLTHRSQAQLMMGSQGRQQFFLPPGLGPWGLRSWLCRVSRRSGQIASEVEKGTPFTFPESVIRASTEGPSAAQNPKREIQKILEFVGRSLPEETVDFMVQHTSFKEMKKNPMTNYTTVPQEFMDHSISPFMRKGMAGDWKTTFTVAQNERFDADYAEKMAGCSLSFRSEL

SEQ ID NO: 755742 - protein, 298 aa, Homo sapiens
DCLPLALMTKNVRLFSVDLRKLEGGSSQAHKIWWRWDHGWWSMPCSRLGCDAIDADYITIEYDGLRDQAGLWLLSRVQLLTWPYRCREISNKSASKPQVPPLPIQEMSWPGTGCVVMVLGLSLLPLQVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFMVQHTSFKEMKKNPMTNYTTVPQEFMDHSISPFMRKGMAGDWKTTFTVAQNERFDADYAEKMAGCSLSFRSEL

SEQ ID NO: 755743 - protein, 254 aa, Homo sapiens
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKEGDRGLHGSAHVVQGDEEEPYDQLHHRPPGVHGPQHLPLHEERHGWGLEDHLHRGAE

SEQ ID NO: 755744 - protein, 427 aa, Homo sapiens
MELIQDTSRPPLEYVKGVPLIKYFAEALGPLQSFQARPDDLLISTYPKSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKEVDHVRCFPPCDSWGQAPHRDPPRPPSPLPGQPPQQDQIPHPAFLAQASPLRPHLAAGPTQLSSLAPESAAWGATDQKLSPIATPCQRVCHPGPQSQKKTITVLTHRSQAQLMMGSQGRQQFFLPPGLGPWGLRSWLCRVSRRSGQIASEVEKGTPFTFPESVIRASTEGPSAAQNPKREIQKILEFVGRSLPEETVDFMVQHTSFKEMKKNPMTNYTTVPQEFMDHSISPFMRKGMAGDWKTTFTVAQNERFDADYAEKMAGCSLSFRSEL

SEQ ID NO: 755745 - protein, 345 aa, Homo sapiens
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFMVQHTRHEYIKQNASDTTAPSPQARRPSSHQLLCDLHSRRGIAGDRKTHISSIDQYIRLQPSIGRTSSTVPKAISGALMVRMESGVPWVEAGGMCELRSPHSHALPLMTYAYRDLTHTLQIRF

SEQ ID NO: 755746 - protein, 225 aa, Homo sapiens
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFVGRSLPDLGKTNFKQ

SEQ ID NO: 755747 - protein, 141 aa, Homo sapiens
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVRQGTVFHIHNPSTLGG

SEQ ID NO: 755748 - protein, 125 aa, Homo sapiens
MELIQDTSRPPLEYVKGVPLIKYFAEALGPLQSFQARPDDLLISTYPKSGTTWVSQILDMIYQGGDLEKCHRAPIFMRVPFLEFKAPGIPSGAVSVSWVQGEWRKTGAGASAHQTFPDPLLGWRL

SEQ ID NO: 755749 - protein, 810 aa, Homo sapiens
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQEREKSVLTPLRGDVASCNTQVAEKPVLTAVPGITRHLTKRLPTKSSQKVEVETSGIGDSLLNVKCAAQTLEKRGKAKPKVNVKPSVVKVVSSPKLAPKRKAVEMHAAVIAAVKPLSSSSVLQEPPAKKAAVAVVPLVSEDKSVTVPEAENPRDSLVLPPTQSSSDSSPPEVSGPSSSQMSMKTRRLSSASTGKPPLSVEDDFEKLIWEISGGKLEAEIDLDPGKDEDDLLLELSEMIDS

SEQ ID NO: 755750 - protein, 810 aa, Homo sapiens; identical to SEQ ID NO: 755749

SEQ ID NO: 755751 - protein, 810 aa, Homo sapiens; identical to SEQ ID NO: 755749

SEQ ID NO: 755752 - protein, 810 aa, Homo sapiens; identical to SEQ ID NO: 755749

SEQ ID NO: 755753 - protein, 810 aa, Homo sapiens; identical to SEQ ID NO: 755749

SEQ ID NO: 755754 - protein, 810 aa, Homo sapiens; identical to SEQ ID NO: 755749

SEQ ID NO: 755755 - protein, 810 aa, Homo sapiens; identical to SEQ ID NO: 755749

SEQ ID NO: 755756 - protein, 810 aa, Homo sapiens; identical to SEQ ID NO: 755749

SEQ ID NO: 755757 - protein, 627 aa, Homo sapiens
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQERDGRETSAHCCARNHTAPDQAASHKVIPEGGGRNLRDWRLIIECEMCSTDLGKKG

SEQ ID NO: 755758 - protein, 450 aa, Homo sapiens
TGPGIPGISSQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQEREKSVLTPLRGDVASCNTQVAEKPVLTAVPGITRHLTKRLPTKSSQKVEVETSGIGDSLLNVKCAAQTLEKRGKAKPKVNVKPSVVKVVSSPKLAPKRKAVEMHAAVIAAVKPLSSSSVLQEPPAKKAAVAVVPLVSEDKSVTVPEAENPRDSLVLPPTQSSSDSSPPEVSGPSSSQMSMKTRRLSSASTGKPPLSVEDDFEKLIWEISGGKLEAEIDLDPGKDEDDLLLELSEMIDS

SEQ ID NO: 755759 - protein, 219 aa, Homo sapiens
MAEKPVLTAVPGITRHLTKRLPTKSSQKVEVETSGIGDSLLNVKCAAQTLEKRGKAKPKVNVKPSVVKVVSSPKLAPKRKAVEMHAAVIAAVKPLSSSSVLQEPPAKKAAVAVVPLVSEDKSVTVPEAENPRDSLVLPPTQSSSDSSPPEVSGPSSSQMSMKTRRLSSASTGKPPLSVEDDFEKLIWEISGGKLEAEIDLDPGKDEDDLLLELSEMIDS

SEQ ID NO: 755760 - protein, 136 aa, Homo sapiens [sequence omitted]

SEQ ID NO: 755761 - protein, 810 aa, Homo sapiens; identical to SEQ ID NO: 755749

SEQ ID NO: 755762 - protein, 810 aa, Homo sapiens; identical to SEQ ID NO: 755749

SEQ ID NO: 755763 - protein, 810 aa, Homo sapiens; identical to SEQ ID NO: 755749

SEQ ID NO: 755764 - protein, 810 aa, Homo sapiens; identical to SEQ ID NO: 755749

SEQ ID NO: 755765 - protein, 80 aa, Homo sapiens
CEPGAIFDAGSLGFLLVLLLLGGRRTAAAKQEERRGSKRESGIVSSVRLNVDILISFLRKVMKPKHLPCNQLLKFTMDYE

SEQ ID NO: 755766 - protein, 791 aa, Homo sapiens
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGHATAHAAQQPFQAQCNMKVRISPRASHTTHTRQHQPAVPLHGAEPPAQCRPSTTQYQRQRSTVSTTEQTASTMHDNSNGTRQHHQLLNTPLPRADVAISSQYPTAGTQIKQMLPTCMYQRNHTGTMTKDGIHNTTVIPTNGWERTTPSRRIREANSIHSRTLLAHQSVGHATKHHNRAHKTRRRVKQTDNPHNVRHHTQTQSKSDPQPTQDTTTPTQRDHKNTTSKGQSQEAHSQPMPQHDSAPLAGEDHSSTLPHQHRTHTRHKPATTTPTDNT

SEQ ID NO: 755767 - protein, 810 aa, Homo sapiens; identical to SEQ ID NO: 755749

SEQ ID NO: 755768 - protein, 810 aa, Homo sapiens; identical to SEQ ID NO: 755749

SEQ ID NO: 755769 - protein, 810 aa, Homo sapiens; identical to SEQ ID NO: 755749

SEQ ID NO: 755770 - protein, 810 aa, Homo sapiens; identical to SEQ ID NO: 755749

SEQ ID NO: 755771 - protein, 810 aa, Homo sapiens; identical to SEQ ID NO: 755749

SEQ ID NO: 755772 - protein, 759 aa, Homo sapiens
MCFSLLQKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQEREKSVLTPLRGDVASCNTQVAEKPVLTAVPGITRHLTKRLPTKSSQKVEVETSGIGDSLLNVKCAAQTLEKRGKAKPKVNVKPSVVKVVSSPKLAPKRKAVEMHAAVIAAVKPLSSSSVLQEPPAKKAAVAVVPLVSEDKSVTVPEAENPRDSLVLPPTQSSSDSSPPEVSGPSSSQMSMKTRRLSSASTGKPPLSVEDDFEKLIWEISGGKLEAEIDLDPGKDEDDLLLELSEMIDS

SEQ ID NO: 755773 - protein, 810 aa, Homo sapiens; identical to SEQ ID NO: 755749

SEQ ID NO: 755774 - protein, 810 aa, Homo sapiens; identical to SEQ ID NO: 755749

SEQ ID NO: 755775 - protein, 810 aa, Homo sapiens; identical to SEQ ID NO: 755749

SEQ ID NO: 755776 - protein, 80 aa, Homo sapiens; identical to SEQ ID NO: 755765

SEQ ID NO: 755777 - protein, 153 aa, Homo sapiens
MHYVHVHRVTTQPRNKPQTKCPSGGQSQGPRGQFLDTVLAAMCPIAMLLTADPGMPPTCLWHTPHAKHKEHLSIHLNMVPKCVHMHVTHTHTNSGSRYVGKYILLIKWSLAMYFVQGSTLSTVTKMSHGKALPDSDTYIQFPNQQGPHTPSIP

SEQ ID NO: 755778 - protein, 153 aa, Homo sapiens; identical to SEQ ID NO: 755777

SEQ ID NO: 755779 - protein, 153 aa, Homo sapiens; identical to SEQ ID NO: 755777

SEQ ID NO: 755780 - protein, 153 aa, Homo sapiens; identical to SEQ ID NO: 755777

SEQ ID NO: 755781 - protein, 143 aa, Homo sapiens
MHYVHVHRVTTQPRNKPQTKCPSGGQSQGPRGQFLDTVLAAMCPIAMLLTADPGMPPTCLWHTPHAKHKEHLSIHLNMVPKCVHMHVTHTHTNSGSRYVGKYILLIKWSLAMYFVQGSTLSTPPFQEKYKGSKLYSICQYFFL

SEQ ID NO: 755782 - protein, 76 aa, Homo sapiens
MASNLCNSQSARHPGLGLGLQGSLEWPLDLRTNRIKGSGKAKARLSSSSPVKELDYGERNQIGANRSAVDSKRKRE

SEQ ID NO: 755783 - protein, 257 aa, Homo sapiens
CKKCLSPPAMILRPPQPCGTGSQCRFRHCEEALGSDTVCSLWRERKCLDPLCRFRHMEMQQNCSISCFWETQPLGCVKISCIFYHSKPRNINGLFLPPSSNITLQKEIQEGIPLQSQSQEPLKPQENISRPIHHPLVLKTNFEEEEEVDEQNDASSLWTKTPEEIEEKRAIKEMCYKSGEYYRFHTPPDILSSKSMTPTAEKQLEKPLENGSELQEGDSLTVPTKLSQYERQGEIKTSLHGKPKTDIAAFENGGELI

SEQ ID NO: 755784 - protein, 257 aa, Homo sapiens
KFEFVCLLATTFSVSAKLEKGSQCRFRHCEEALGSDTVCSLWRERKCLDPLCRFRHMEMQQNCSISCFWETQPLGCVKISCIFYHSKPRNINGLFLPPSSNITLQKEIQEGIPLQSQSQEPLKPQENISRPIHHPLVLKTNFEEEEEVDEQNDASSLWTKTPEEIEEKRAIKEMCYKSGEYYRFHTPPDILSSKSMTPTAEKQLEKPLENGSELQEGDSLTVPTKLSQYERQGEIKTSLHGKPKTDIAAFENGGELI

SEQ ID NO: 755785 - protein, 1766 aa, Homo sapiens
MDKKFLSNPPAGFPSSRSDAERRQACDAILRACNQQLTAKLACPRHLGSLLELAELACDGYLVSTPQRPPLYLERILFVLLRNAAAQGSPEATLRLAQPLHACLVQCSREAAPQDYEAVARGSFSLLWKGAEALLERRAAFAARLKALSFLVLLEDESTPCEVPHFASPTACRAVAAHQLFDASGHGLNEADADFLDDLLSRHVIRALVGERGSSSGLLSPQRALCLLELTLEHCRRFCWSRHHDKAISAVEKAHSYLRNTNLAPSLQLCQLGVKLLQVGEEGPQAVAKLLIKASAVLSKSMEAPSPPLRALYESCQFFLSGLERGTKRRYRLDAILSLFAFLGGYCSLLQQLRDDGVYGGSSKQQQSFLQMYFQGLHLYTVVVYDFAQGCQIVDLADLTQLVDSCKSTVVWMLEALEGLSGQELTDHMGMTASYTSNLAYSFYSHKLYAEACAISEPLCQHLGLVKPGTYPEVPPEKLHRCFRLQVESLKKLGKQAQGCKMVILWLAALQPCSPEHMAEPVTFWVRVKMDAARAGDKELQLKTLRDSLSGWDPETLALLLREELQAYKAVRADTGQERFNIICDLLELSPEETPAGAWARATHLVELAQVLCYHDFTQQTNCSALDAIREALQLLDSVRPEAQARDQLLDDKAQALLWLYICTLEAKIQEGIERDRRAQAPGNLEEFEVNDLNYEDKLQEDRFLYSNIAFNLAADAAQSKCLDQALALWKELLTKGQAPAVRCLQQTAASLQILAALYQLVAKPMQALEVLLLLRIVSERLKDHSKAAGSSCHITQLLLTLGCPSYAQLHLEEAASSLKHLDQTTDTYLLLSLTCDLLRSQLYWTHQKVTKGVSLLLSVLRDPALQKSSKAWYLLRVQVLQLVAAYLSLPSNNLSHSLWEQLCAQGWQTPEIALIDSHKLLRSIILLLMGSDILSTQKAAVETSFLDYGENLVQKWQVLSEVLSCSEKLVCHLGRLGSVSEAKAFCLEALKLTTKLQIPRQCALFLVLKGELELARNDIDLCQSDLQQVLFCLSLAQVNFSDDSDLEDPVSAEAWLAEEPKRRGTASRGRGRARKGLSLMTDAVVAPGSAPGNPGLNGRSRRAKKVASRHCEERRPQRASDQARPGPEIMRTIPEEELTDNWRKMSFEILRGSDGEDSASGGKTPAPGPEAASGEWELLRLDSSKKKLPSPCPDKESDKDLGPRLRLPSAPVATGLSTLDSICDSLSVAFRGISHCPPSGLYAHLCRFLALCLGHRDPYATAFLVTESVSITCRHQLLTHLHRQLSKAQKHRGSLEIADQLQGLSLQEMPGDVPLARIQRLFSFRALESGHFPQPEKESFQERLALIPSGVTVCVLALATLQPGTVGNTLLLTRLEKDSPPVSVQIPTGQNKLHLRSVLNEFDAIQKAQKENSSCTDKREWWTGRLALDHRMEVLIASLEKSVLGCWKGLLLPSSEEPGPAQEASRLQELLQDCGWKYPDRTLLKIMLSGAGALTPQDIQALAYGLCPTQPERAQELLNEAVGRLQGLTVPSNSHLVLVLDKDLQKLPWESMPSLQALPVTRLPSFRFLLSYSIIKEYGASPVLSQGVDPRSTFYVLNPHNNLSSTEEQFRANFSSEAGWRGVVGEVPRPEQVQEALTKHDLYIYAGHGAGARFLDGQAVLRLSCRAVALLFGCSSAALAVHGNLEGAGIVLKYIMAGCPLFLGNLWDVTDRDIDRYTEALLQGWLGAGPGAPLLYYVNQARQAPRLKYLIGAAPIAYGLPVSLR

SEQ ID NO: 755786 - protein, 2096 aa, Homo sapiens
MDKKFLSNPPAGFPSSRSDAERRQACDAILRACNQQLTAKLACPRHLGSLLELAELACDGYLVSTPQRPPLYLERILFVLLRNAAAQGSPEATLRLAQPLHACLVQCSREAAPQDYEAVARGSFSLLWKGAEALLERRAAFAARLKALSFLVLLEDESTPCEVPHFASPTACRAVAAHQLFDASGHGLNEADADFLDDLLSRHVIRALVGERGSSSGLLSPQRALCLLELTLEHCRRFCWSRHHDKAISAVEKAHSYLRNTNLAPSLQLCQLGVKLLQVGEEGPQAVAKLLIKASAVLSKSMEAPSPPLRALYESCQFFLSGLERGTKRRYRLDAILSLFAFLGGYCSLLQQLRDDGVYGGSSKQQQSFLQMYFQGLHLYTVVVYDFAQGCQIVDLADLTQLVDSCKSTVVWMLEALEGLSGQELTDHMGMTASYTSNLAYSFYSHKLYAEACAISEPLCQHLGLVKPGTYPEVPPEKLHRCFRLQVESLKKLGKQAQGCKMVILWLAALQPCSPEHMAEPVTFWVRVKMDAARAGDKELQLKTLRDSLSGWDPETLALLLREELQAYKAVRADTGQERFNIICDLLELSPEETPAGAWARATHLVELAQVLCYHDFTQQTNCSALDAIREALQLLDSVRPEAQARDQLLDDKAQALLWLYICTLEAKIQEGIERDRRAQAPGNLEEFEVNDLNYEDKLQEDRFLYSNIAFNLAADAAQSKCLDQALALWKELLTKGQAPAVRCLQQTAASLQILAALYQLVAKPMQALEVLLLLRIVSERLKDHSKAAGSSCHITQLLLTLGCPSYAQLHLEEAASSLKHLDQTTDTYLLLSLTCDLLRSQLYWTHQKVTKGVSLLLSVLRDPALQKSSKAWYLLRVQVLQLVAAYLSLPSNNLSHSLWEQLCAQGWQTPEIALIDSHKLLRSIILLLMGSDILSTQKAAVETSFLDYGENLVQKWQVLSEVLSCSEKLVCHLGRLGSVSEAKAFCLEALKLTTKLQIPRQCALFLVLKGELELARNDIDLCQSDLQQVLFLLESCTEFGGVTQHLDSVKKVHLQKGKQQAQVPCPPQLPEEELFLRGPALELVATVAKEPGPIAPSTNSSPVLKTKPQPIPNFLSHSPTCDCSLCASPVLTAVCLRWVLVTAGVRLAMGHQAQGLDLLQVVLKGCPEAAERLTQALQASLNHKTPPSLVPSLLDEILAQAYTLLALEGLNQPSNESLQKVLQSGLKFVAARIPHLEPWRASLLLIWALTKLGGLSCCTTQLFASSWGWQPPLIKSVPGSEPSKTQGQKRSGRGRQKLASAPLRLNNTSQKGLEGRGLPCTPKPPDRIRQAGPHVPFTVFEEVCPTESKPEVPQAPRVQQRVQTRLKVNFSDDSDLEDPVSAEAWLAEEPKRRGTASRGRGRARKGLSLMTDAVVAPGSAPGNPGLNGRSRRAKKVASRHCEERRPQRASDQARPGPEIMRTIPEEELTDNWRKMSFEILRGSDGEDSASGGKTPAPGPEAASGEWELLRLDSSKKKLPSPCPDKESDKDLGPRLRLPSAPVATGLSTLDSICDSLSVAFRGISHCPPSGLYAHLCRFLALCLGHRDPYATAFLVTESVSITCRHQLLTHLHRQLSKAQKHRGSLEIADQLQGLSLQEMPGDVPLARIQRLFSFRALESGHFPQPEKESFQERLALIPSGVTVCVLALATLQPGTVGNTLLLTRLEKDSPPVSVQIPTGQNKLHLRSVLNEFDAIQKAQKENSSCTDKREWWTGRLALDHRMEVLIASLEKSVLGCWKGLLLPSSEEPGPAQEASRLQELLQDCGWKYPDRTLLKIMLSGAGALTPQDIQALAYGLCPTQPERAQELLNEAVGRLQGLTVPSNSHLVLVLDKDLQKLPWESMPSLQALPVTRLPSFRFLLSYSIIKEYGASPVLSQGVDPRSTFYVLNPHNNLSSTEEQFRANFSSEAGWRGVVGEVPRPEQVQEALTKHDLYIYAGHGAGARFLDGQAVLRLSCRAVALLFGCSSAALAVHGNLEGAGIVLKYIMAGCPLFLGNLWDVTDRDIDRYTEALLQGWLGAGPGAPLLYYVNQARQAPRLKYLIGAAPIAYGLPVSLR

SEQ ID NO: 755787 - protein, 1476 aa, Homo sapiens
MDKKFLSNPPAGFPSSRSDAERRQACDAILRACNQQLTAKLACPRHLGSLLELAELACDGYLVSTPQRPPLYLERILFVLLRNAAAQGSPEATLRLAQPLHACLVQCSREAAPQDYEAVARGSFSLLWKGAEALLERRAAFAARLKALSFLVLLEDESTPCEVPHFASPTACRAVAAHQLFDASGHGLNEADADFLDDLLSRHVIRALVGERGSSSGLLSPQRALCLLELTLEHCRRFCWSRHHDKAISAVEKAHSYLRNTNLAPSLQLCQLGVKLLQVGEEGPQAVAKLLIKASAVLSKSMEAPSPPLRALYESCQFFLSGLERGTKRRYRLDAILSLFAFLGGYCSLLQQLRDDGVYGGSSKQQQSFLQMYFQGLHLYTVVVYDFAQGCQIVDLADLTQLVDSCKSTVVWMLEALEGLSGQELTDHMGMTASYTSNLAYSFYSHKLYAEACAISEPLCQHLGLVKPGTYPEVPPEKLHRCFRLQVESLKKLGKQAQGCKMVILWLAALQPCSPEHMAEPVTFWVRVKMDAARAGDKELQLKTLRDSLSGWDPETLALLLREELQAYKAVRADTGQERFNIICDLLELSPEETPAGAWARATHLVELAQVLCYHDFTQQTNCSALDAIREALQLLDSVRPEAQARDQLLDDKAQALLWLYICTLEAKIQEGIERDRRAQAPGNLEEFEVNDLNYEDKLQEDRFLYSNIAFNLAADAAQSKCLDQALALWKELLTKGQAPAVRCLQQTAASLQILAALYQLVAKPMQALEVLLLLRIVSERLKDHSKAAGSSCHITQLLLTLGCPSYAQLHLEEAASSLKHLDQTTDTYLLLSLTCDLLRSQLYWTHQKVTKGVSLLLSVLRDPALQKSSKAWYLLRVQVLQLVAAYLSLPSNNLSHSLWEQLCAQGWQTPEIALIDSHKLLRSIILLLMGSDILSTQKAAVETSFLDYGENLVQKWQVLSEVLSCSEKLVCHLGRLGSVSEAKAFCLEALKLTTKLQIPRQCALFLVLKGELELARNDIDLCQSDLQQVLFLLESCTEFGGVTQHLDSVKKVHLQKGKQQAQVPCPPQLPEEELFLRGPALELVATVAKEPGPIAPSTNSSPVLKTKPQPIPNFLSHSPTCDCSLCASPVLTAVCLRWVLVTAGVRLAMGHQAQGLDLLQVVLKGCPEAAERLTQALQASLNHKTPPSLVPSLLDEILAQAYTLLALEGLNQPSNESLQKVLQSGLKFVAARIPHLEPWRASLLLIWALTKLGGLSCCTTQLFASSWGWQPPLIKSVPGSEPSKTQGQKRSGRGRQKLASAPLRLNNTSQKGLEGRGLPCTPKPPDRIRQAGPHVPFTVFEEVCPTESKPEVPQAPRVQQRVQTRLKVNFSDDSDLEDPVSAEAWLAEEPKRRGTASRGRGRARKGLSLMTDAVVAPGSAPGNPGLNGRSRRAKKVASRHCEERRPQRASDQARPGPEIMRTIPEEELTDNWRLQ

SEQ ID NO: 755788 - protein, 126 aa, Homo sapiens
GTEELGAGQQLKSGSGRGRRGPGPALRGRWGQERLRQGPPSVLFSHVLGPLSSFPAGNIHAVLGGAAFPRGTELPGRALLPSRGGLGAVACGGRQPLLRCVSRWSQKTAVQGKGPLPDTQGQIFFS

SEQ ID NO: 755789 - protein, 1390 aa, Homo sapiens
MLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLEVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 755790 - protein, 1425 aa, Homo sapiens
MLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 755791 - protein, 1425 aa, Homo sapiens; identical to SEQ ID NO: 755790

SEQ ID NO: 755792 - protein, 1425 aa, Homo sapiens; identical to SEQ ID NO: 755790

SEQ ID NO: 755793 - protein, 1128 aa, Homo sapiens
MATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 755794 - protein, 565 aa, Homo sapiens
MQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 755795 - protein, 1410 aa, Homo sapiens
MLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSVQTLRRRDELRTEPEAKKSKTAAKKNDKGAAGEGPALYEDPPDQKTSPSGKPAKLKICSWTVDGLRALDYEERIRWGKEKKPQIYCASLKTLISEGQLFMQNEASCTPWRRELYIPNV

SEQ ID NO: 755796 - protein, 1199 aa, Homo sapiens
MLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRGPKVPKVIQKGLGKKRKGILGA

SEQ ID NO: 755797 - protein, 348 aa, Homo sapiens [sequence omitted]

SEQ ID NO: 755798 - protein, 74 aa, Homo sapiens
GQVAATGGVRGETESHSVTRLECSGTIITHYSLGLLDSSRPPASASQVAEEVCTTTHIYIRVRSLEIGVLVLDC

SEQ ID NO: 755799 - protein, 1425 aa, Homo sapiens; identical to SEQ ID NO: 755790

SEQ ID NO: 755800 - protein, 1390 aa, Homo sapiens; identical to SEQ ID NO: 755789

SEQ ID NO: 755801 - protein, 1425 aa, Homo sapiens; identical to SEQ ID NO: 755790

SEQ ID NO: 755802 - protein, 1293 aa, Homo sapiens
MLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSD

SEQ ID NO: 755803 - protein, 745 aa, Homo sapiens
GDVMIVRVSRLQNKNTKEKKETKRNMRPWGLSDYKTIRARMSMTRVWNRNIRVISVGGGAHQSVQHWLDSLIPGSSEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 755804 - protein, 655 aa, Homo sapiens
ALKKELQERKKENQELVASKCDLSLMLKEAQNTKKNLEKEHTHILQAKESLDAQLNTCCSEKNILLRDGLNLQEECHKLSKEIQEMQQSLILEQEARAKESESSLYENNQLHGRMVLLEQEVEELRVCIEELQSEKFVLLQEKSKSEQELAEIIEEKELLTAEAAQLAAHIKTLKSDFAALSKSKAELQELHSCLTKILDDLQRNHEVTLAEKAQVMQDNQNLLAEKSEMMLEKDELLKEKETLAESYFILQKEISQLAKTNSHISANLLESQNENRTLRKDKNKLTLKIRELETLQSFTAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 755805 - protein, 1101 aa, Homo sapiens
MLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKVRDAREFPCVVACLSSVSRQEGCLESSSQWE

SEQ ID NO: 755806 - protein, 882 aa, Homo sapiens
MLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILVSTCWESESQGFWPFPVLKNPPVRNIVAVSFLFLSVDST

SEQ ID NO: 755807 - protein, 121 aa, Homo sapiens
LTKVQANVCGLQKAQAIERQLVSLSQTLCLYNLVPSVSLHFGAADLAGCTEGYKLTGLPTEHSRQGSCLAEVPSHIKWGWPCQHLCHPLPNRLPRKTQAMVPLMGFVGNSTAPLKSQSAAN

SEQ ID NO: 755808 - protein, 193 aa, Homo sapiens
MLGVLELLLLGAAWLAGPARGQNETEPIVLEGKCLVVCDSNPTSDPTGTALGISVRSGSAKVAFSAIRSTNHEPSEMSNRTMIIYFDQVLVNIGNNFDSERSTFIAPRKGIYSFNFHVVKVYNRQTIQVSLMLNGWPVISAFAGDQDVTREAASNGVLIQMEKGDRAYLKLERGNLMGGWKYSTFSGFLVFPL

SEQ ID NO: 755809 - protein, 193 aa, Homo sapiens; identical to SEQ ID NO: 755808

SEQ ID NO: 755810 - protein, 921 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 755811 - protein, 723 aa, Homo sapiens
MQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 755812 - protein, 920 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLIFFFFLLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 755813 - protein, 731 aa, Homo sapiens
MQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 755814 - protein, 111 aa, Homo sapiens
IAAEAPQHRGSSHSPLPTSAPSSRAGLPPLAMTLDLTSGWRLWTPIQPFRLPPGSCREGTILLCSVMDGCTAPLLPNSACVPCGSGHELNPCKAYTTSHSPGPQSSTWMRQ

SEQ ID NO: 755815 - protein, 188 aa, Homo sapiens [sequence omitted]

SEQ ID NO: 755816 - protein, 211 aa, Homo sapiens
AGARRRRGRAPACARSRHRMVGGGQPCGPNMSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLHTCR

SEQ ID NO: 755817 - protein, 178 aa, Homo sapiens
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQ

SEQ ID NO: 755818 - protein, 178 aa, Homo sapiens; identical to SEQ ID NO: 755817

SEQ ID NO: 755819 - protein, 178 aa, Homo sapiens; identical to SEQ ID NO: 755817

SEQ ID NO: 755820 - protein, 178 aa, Homo sapiens; identical to SEQ ID NO: 755817

SEQ ID NO: 755821 - protein, 188 aa, Homo sapiens [sequence omitted]

SEQ ID NO: 755822 - protein, 178 aa, Homo sapiens; identical to SEQ ID NO: 755817

SEQ ID NO: 755823 - protein, 189 aa, Homo sapiens
MVGGGQPCGPNMSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQ

SEQ ID NO: 755824 - protein, 189 aa, Homo sapiens; identical to SEQ ID NO: 755823

SEQ ID NO: 755825 - protein, 189 aa, Homo sapiens; identical to SEQ ID NO: 755823

SEQ ID NO: 755826 - protein, 90 aa, Homo sapiens
GDLEDLQDDVKGCSMYVALFPCNECAKLIIQAGIKEVIFMSDKYHDSDEATAARLLFNMAGVTFRKFIPKCSKIVIDFDSINSRPSQKLQ

SEQ ID NO: 755827 - protein, 189 aa, Homo sapiens; identical to SEQ ID NO: 755823

SEQ ID NO: 755828 - protein, 178 aa, Homo sapiens; identical to SEQ ID NO: 755817

SEQ ID NO: 755829 - protein, 196 aa, Homo sapiens
SGHRRVAPSRARGAGRWLPGGGLGPRTLGAPRPRSAFRSENAGGVGALGVPAVTPGSISRRAPRPVRGRAPWSAPGGGAGRLNTTSLPAPVCGLGMPGVGPGSELTGLRAAWGVPGTVTGCVFLNRCIRAPVLSVSTAGPQSSQGSSGRSATPGEGAQGINRTLPSPALPSPPMAPPPSYLVGTSPAPHSDDGCWP

SEQ ID NO: 755830 - protein, 189 aa, Homo sapiens; identical to SEQ ID NO: 755823

SEQ ID NO: 755831 - protein, 189 aa, Homo sapiens; identical to SEQ ID NO: 755823

SEQ ID NO: 755832 - protein, 178 aa, Homo sapiens; identical to SEQ ID NO: 755817

SEQ ID NO: 755833 - protein, 178 aa, Homo sapiens; identical to SEQ ID NO: 755817

SEQ ID NO: 755834 - protein, 189 aa, Homo sapiens; identical to SEQ ID NO: 755823

SEQ ID NO: 755835 - protein, 119 aa, Homo sapiens
MARVFYGCGLLISTEKQRSKFPVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQ

SEQ ID NO: 755836 - protein, 189 aa, Homo sapiens; identical to SEQ ID NO: 755823

SEQ ID NO: 755837 - protein, 130 aa, Homo sapiens
MARVFYGCGLLISTEKQRSKFPAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQ

SEQ ID NO: 755838 - protein, 206 aa, Homo sapiens
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQRSTLMLRAALFTAARRGRRPGVPRWMNG

SEQ ID NO: 755839 - protein, 196 aa, Homo sapiens; identical to SEQ ID NO: 755829

SEQ ID NO: 755840 - protein, 317 aa, Homo sapiens
QPQTHHLAVDTCVSMWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKGVILGVHLSVMVCFKVSHHGALSHVPCLKSLLCTPRWCITGSGSRTPSQPTPECPCPTPTSSKFKSTSRSGITWPFWMLDT

SEQ ID NO: 755841 - protein, 275 aa, Homo sapiens
QPQTHHLAVDTCVSMWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 755842 - protein, 111 aa, Homo sapiens
REKGGRGPELWAGPPATTEPSLQPQLQVSHPHASPPPPATPHSSDAPVASLLFLSHTVSPLASSLLFLLLSLTSRILFSFVYFSLPSWFCSFSLPLPHVYFLLSLSLLCSS

SEQ ID NO: 755843 - protein, 145 aa, Homo sapiens
GREEERGGCMAGVRDQGQGARWPHTGKRGPLLQGLTWATGGHCFSSEESGAVDGAGQKKDRAWLRVILGVHLSVMVCFKVSHHGALSHVPCLKSLLCTPRWCITGSGSRTPSQPTPECPCPTPTSSKFKSTSRSGITWPFWMLDT

SEQ ID NO: 755844 - protein, 201 aa, Homo sapiens
MSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKGVILGVHLSVMVCFKVSHHGALSHVPCLKSLLCTPRWCITGSGSRTPSQPTPECPCPTPTSSKFKSTSRSGITWPFWMLDT

SEQ ID NO: 755845 - protein, 253 aa, Homo sapiens
QPQTHHLAVDTCVSMWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGHNSPIPVLSTCLLGTCYVTSIAVDPGKQQ

SEQ ID NO: 755846 - protein, 128 aa, Homo sapiens
GCGGSDDEDDLGVAPGLAPAWALTQPPSQSPGPQSLPSTPSSIWPQWVILITELTIPSPAHGPPWLPNALERGHLAQRVVLKRWPLRCACGGSILQMVPALILLTCLQGLSSWTLPLVQELDPEVPSP

SEQ ID NO: 755847 - protein, 201 aa, Homo sapiens; identical to SEQ ID NO: 755844

SEQ ID NO: 755848 - protein, 102 aa, Homo sapiens
MSLLKHQSLRPDEDSSHDLMLLRLSEPAKITDVVKVLGLPTQEPALGTTCYASGWGSIEPEEFLRPRSLQCVSLHPCPTPTSSKFKSTSRSGITWPFWMLDT

SEQ ID NO: 755849 - protein, 275 aa, Homo sapiens; identical to SEQ ID NO: 755841

SEQ ID NO: 755850 - protein, 275 aa, Homo sapiens; identical to SEQ ID NO: 755841

SEQ ID NO: 755851 - protein, 275 aa, Homo sapiens; identical to SEQ ID NO: 755841

SEQ ID NO: 755852 - protein, 275 aa, Homo sapiens; identical to SEQ ID NO: 755841

SEQ ID NO: 755853 - protein, 111 aa, Homo sapiens; identical to SEQ ID NO: 755842

SEQ ID NO: 755854 - protein, 275 aa, Homo sapiens; identical to SEQ ID NO: 755841

SEQ ID NO: 755855 - protein, 83 aa, Homo sapiens
QPQTHHLAVDTCVSMWDLVLSIALSVGCTGAVPLIQSRIVGGWECEKHSQPWQVAVYSHGWAHCGGVLVHPQWVLTAAHCLKK

SEQ ID NO: 755856 - protein, 80 aa, Homo sapiens
IRGRIDAASRAARKRNGQTQVYANVSEMGIISSSPSEHWLSLKTSRSVSVRTHTKTWVTMLFVGCRDGRGVSTFLKGSFH

SEQ ID NO: 755857 - protein, 111 aa, Homo sapiens; identical to SEQ ID NO: 755842

SEQ ID NO: 755858 - protein, 263 aa, Homo sapiens
APNSPPGRGHLCQHVGPGSLHRLVCGVHWNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKGVILGVHLSVMVCFKVSHHGALSHVPCLKSLLCTPRWCITGSGSRTPSQPTPECPCPTPTSSKFKSTSRSGITWPFWMLDT

SEQ ID NO: 755859 - protein, 275 aa, Homo sapiens; identical to SEQ ID NO: 755841

SEQ ID NO: 755860 - protein, 275 aa, Homo sapiens; identical to SEQ ID NO: 755841

SEQ ID NO: 755861 - protein, 275 aa, Homo sapiens; identical to SEQ ID NO: 755841

SEQ ID NO: 755862 - protein, 127 aa, Homo sapiens
MSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKGMDRGIL

SEQ ID NO: 755863 - protein, 275 aa, Homo sapiens; identical to SEQ ID NO: 755841

SEQ ID NO: 755864 - protein, 253 aa, Homo sapiens; identical to SEQ ID NO: 755845

SEQ ID NO: 755865 - protein, 203 aa, Homo sapiens
MVMFKKIKSFEVVFNDPEKVYGSGEKVAGRVIVEVCEVTRVKAVRILACGVAKVLWMQGSQQCKQTSEYLRYEDTLLLEDQPTGENEMVIMRPGNKYEYKFGFELPQGPLGTSFKGKYGCVDYWVKAFLDRPSQPTQETKKNFEVVDLVDVNTPDLMAPVSAKKEKKVSCMFIPDGRVSVSARIDRKGFCEGERGKFHPMADF

SEQ ID NO: 755866 - protein, 138 aa, Homo sapiens
MPPKHSLSHRCILSVTASLMATRFSFPSGENEMVIMRPGNKYEYKFGFELPQGPLGTSFKGKYGCVDYWVKAFLDRPSQPTQETKKNFEVVDLVDVNTPDLMAPVSAKKEKKVSCMFIPDGRVSVSARIDRKGFCEGR

SEQ ID NO: 755867 - protein, 277 aa, Homo sapiens
MLNIHRTKFGKVNCVGLYAGLRCSYDLCIAIFSSLAKRLKRFYHLQACGEHEQEADKQGGKFLLYLVERIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTEVDPCILNNNVQ

SEQ ID NO: 755868 - protein, 138 aa, Homo sapiens; identical to SEQ ID NO: 755866

SEQ ID NO: 755869 - protein, 138 aa, Homo sapiens; identical to SEQ ID NO: 755866

SEQ ID NO: 755870 - protein, 129 aa, Homo sapiens
GTSALLVSFEVEYSEIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTEVDPCILNNNVQ

SEQ ID NO: 755871 - protein, 263 aa, Homo sapiens
MFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTELILRWIPASSTTMCSEHVEEKKQLYLLVSFCLSSWTLTFSETQQSLQWSVGPP

SEQ ID NO: 755872 - protein, 214 aa, Homo sapiens
MFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTELILR

SEQ ID NO: 755873 - protein, 241 aa, Homo sapiens
MATRFSFPSGENEMVIMRPGNKYEYKFGFELPQGPLGTSFKGKYGCVDYWVKAFLDRPSQPTQETKKNFEVVDLVDVNTPDLMAPVSAKKEKKVSCMFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLVGRCRVASAEKLFICYHSCLVSPDLWCNKLPSSFLDLC

SEQ ID NO: 755874 - protein, 89 aa, Homo sapiens
KLRLGTRLGVNSARMSWVDLNIPDTPEAPPCYMDVIPEDHRLESPTTPLLDDMDGSQDSPIFMYAPEFKFMPPPTYTEVDPCILNNNVQ

SEQ ID NO: 755875 - protein, 77 aa, Homo sapiens
RVGLVAYWNIPDTPEAPPCYMDVIPEDHRLESPTTPLLDDMDGSQDSPIFMYAPEFKFMPPPTYTEVDPCILNNNVQ

SEQ ID NO: 755876 - protein, 245 aa, Homo sapiens
MFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTELILRWIPASSTTMCSEHVEDFSETQQSLQWSVGPP

SEQ ID NO: 755877 - protein, 221 aa, Homo sapiens [sequence omitted]

SEQ ID NO: 755878 - protein, 221 aa, Homo sapiens [sequence omitted]

SEQ ID NO: 755879 - protein, 221 aa, Homo sapiens [sequence omitted]

SEQ ID NO: 755880 - protein, 221 aa, Homo sapiens [sequence omitted]

SEQ ID NO: 755881 - protein, 214 aa, Homo sapiens; identical to SEQ ID NO: 755872

SEQ ID NO: 755882 - protein, 221 aa, Homo sapiens [sequence omitted]

SEQ ID NO: 755883 - protein, 221 aa, Homo sapiens [sequence omitted]

SEQ ID NO: 755884 - protein, 221 aa, Homo sapiens [sequence omitted]

SEQ ID NO: 755885 - protein, 221 aa, Homo sapiens [sequence omitted]

SEQ ID NO: 755886 - protein, 221 aa, Homo sapiens [sequence omitted]

SEQ ID NO: 755887 - protein, 221 aa, Homo sapiens [sequence omitted]

SEQ ID NO: 755888 - protein, 221 aa, Homo sapiens [sequence omitted]

SEQ ID NO: 755889 - protein, 336 aa, Homo sapiens
MFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEVQRKYGCVDYWVKAFLDRPSQPIQETKKNFEVVDLVDVNTPDLMAPVSAKKERKVSCMFIPDGRVSVSARIDRKGFCEGDEISIHADFENTCSRIVSPKLPLCPPHLPCNGQTKVLTQKLSSVRGNHIISGTCASWRGKSLRVQKIRPSILGCNILRVEYSLLIYVSVPGSIFIKAL

SEQ ID NO: 755890 - protein, 263 aa, Homo sapiens; identical to SEQ ID NO: 755871

SEQ ID NO: 755891 - protein, 234 aa, Homo sapiens
MFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTESYIRKSEAKLDPHSIAETVESLKK

SEQ ID NO: 755892 - protein, 107 aa, Homo sapiens [sequence omitted]

SEQ ID NO: 755893 - protein, 138 aa, Homo sapiens; identical to SEQ ID NO: 755866

SEQ ID NO: 755894 - protein, 102 aa, Homo sapiens
MVMFKKIKSFEVVFNDPEKVYGSGEKVAGRVIVEVCEVTRVKAVRILACGVAKVLWMQGSQQCKQTSEYLRYEDTLLLEDQPTAAIALCSLSCVRALSSTLF

SEQ ID NO: 755895 - protein, 221 aa, Homo sapiens [sequence omitted]

SEQ ID NO: 755896 - protein, 107 aa, Homo sapiens [sequence omitted]

SEQ ID NO: 755897 - protein, 241 aa, Homo sapiens; identical to SEQ ID NO: 755873

SEQ ID NO: 755898 - protein, 194 aa, Homo sapiens
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 755899 - protein, 196 aa, Homo sapiens
RAQWWPPRLVLKCRRVPGAPLGPGLLALSLSFLICTVGTSTVTLARQDGPGCGEGPRLRAGTYLVQGPETGSDSVPAGNFTSDPVSALQLKTTKEHTYIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 755900 - protein, 97 aa, Homo sapiens
MHKWILTWILPTLLYRSCFHIICLVGTISLACNDMTPEQMATNVNCSSPERHTRSYDYMEGEDIRVRRLFCRTQWYLRIDKRGKVKGTQEMKNNYSK

SEQ ID NO: 755901 - protein, 101 aa, Homo sapiens
GGDLDHGELSPWFNTHSPLGLFSQQSSREICLFLFIYLRQSFALGCPGFLYSPSEKEQPIEQQDGSIVHWTMRDTIHISFAQFFLNQVFESLQMKKTFSKY

SEQ ID NO: 755902 - protein, 1173 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKRGGGGGRRSKKGGEFDEFVNDDTDDDLPISKKKKRRKGSGSEQEGEDEEGGERKKKKRRRHPKGEEGSDDDETENGPKPKKRRPPKAEKKKAPKPERLPPSMKGKIKSKAIISSSDDSSDEDKLKIADEGHPRNSNSNSDSDEDEQRKKCASSESDSDENQNKSGSEAGSPRRPRRQRSDQDSDSDQPSRKRRPSGSEQSDNESVQSGRSHSGVSENDSRPASPSAESDHESERGSDNEGSGQGSGNESEPEGSNNEASDRGSEHGSDDSD

SEQ ID NO: 755903 - protein, 146 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQVKIKSNFFPFMKGEKHMK

SEQ ID NO: 755904 - protein, 134 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKEIKGTNLKKGIFYLPPGPPFGLITKWGPDKNLI

SEQ ID NO: 755905 - protein, 1176 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKRGGGGGRRSKKGGEFDEFVNDDTDDDLPISKKKKRRKGSGSEQEGEDEEGGERKKKKRRRHPKGEEGSDDDETENGPKPKKRRPPKAEKKKAPKPERLPPSMKGKIKSKAIISSSDDSSDEDKLKIADEGRTNNERNVPHQRVIPMRTRTSLAARPAVPGGHEDSGQIRTQTVTSHPEREGPPVLSSLTMNLCSQGEATQEFLRTTLAQLLQVPNQITNRREDLIMRVLAKALEMNRNQRDPTMRPQIEAQNMGQMIVTRFYFINKLHLWRKLF

SEQ ID NO: 755906 - protein, 959 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNEEKRLREKEEQKKLLEQRAQYVEKTKNILMFTGETEATKEKKRGGGGGRRSKKGGEFDEFVNDDTDDDLPISKKKKRRKGSGSEQEGEDEEGGERKKKKRRRHPKGEEGSDDDETENGPKPKKRRPPKAEKKKAPKPERLPPSMKGKIKSKAIISSSDDSSDEDKLKIADEGHPRNSNSNSDSDEDEQRKKCASSESDSDENQNKSGSEAGSPRRPRRQRSDQDSDSDQPSRKRRPSGSEQSDNESVQSGRSHSGVSENDSRPASPSAESDHESERGSDNEGSGQGSGNESEPEGSNNEASDRGSEHGSDDSD

SEQ ID NO: 755907 - protein, 566 aa, Homo sapiens
LTRLPLAEAGSTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKRGGGGGRRSKKGGEFDEFVNDDTDDDLPISKKKKRRKGSGSEQEGEDEEGGERKKKKRRRHPKGEEGSDDDETENGPKPKKRRPPKAEKKKAPKPERLPPSMKGKIKSKAIISSSDDSSDEDKLKIADEGHPRNSNSNSDSDEDEQRKKCASSESDSDENQNKSGSEAGSPRRPRRQRSDQDSDSDQPSRKRRPSGSEQSDNESVQSGRSHSGVSENDSRPASPSAESDHESERGSDNEGSGQGSGNESEPEGSNNEASDRGSEHGSDDSD

SEQ ID NO: 755908 - protein, 1173 aa, Homo sapiens; identical to SEQ ID NO: 755902

SEQ ID NO: 755909 - protein, 1173 aa, Homo sapiens; identical to SEQ ID NO: 755902

SEQ ID NO: 755910 - protein, 1173 aa, Homo sapiens; identical to SEQ ID NO: 755902

SEQ ID NO: 755911 - protein, 299 aa, Homo sapiens
KKAQGAFGGEPRGGRNSGIETEATKEKKRGGGGGRRSKKGGEFDEFVNDDTDDDLPISKKKKRRKGSGSEQEGEDEEGGERKKKKRRRHPKGEEGSDDDETENGPKPKKRRPPKAEKKKAPKPERLPPSMKGKIKSKAIISSSDDSSDEDKLKIADEGHPRNSNSNSDSDEDEQRKKCASSESDSDENQNKSGSEAGSPRRPRRQRSDQDSDSDQPSRKRRPSGSEQSDNESVQSGRSHSGVSENDSRPASPSAESDHESERGSDNEGSGQGSGNESEPEGSNNEASDRGSEHGSDDSD

SEQ ID NO: 755912 - protein, 1039 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKRGGGGGRRSKKGGEFDEFVNDDTDDDLPISKKKKRRKGSGSEQEGEDEEGGERKKKKRRRHSKGEERSLFVEKQKWGPKPKKRRAPQKRENKKGFQTENVVSLYVRGNKKSKTHIFFKGRLFRVEVFDGGRTNGWRS

SEQ ID NO: 755913 - protein, 138 aa, Homo sapiens
TTGWYGPGSKGTRTSLAARPAVPGGHEDSGQIRTQTVTSHPEREGPPVLSSLTMNLCSQGEATQEFLRTTLAQLLQVPNQITNRREDLIMRVLAKALEMNRNQRDPTMRPQIEAQNMGQMIVTRFYFINKLHLWRKLF

SEQ ID NO: 755914 - protein, 1017 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKKRGGGGPRSKKGREVDEFGHGDTGDDPPLFQKKKRKKGVTKKAKKREVAGGKKKKSESLPKGENGLFVSKMKKARAIKNLSPKGTNKKGAKGQKVAPSPEGIIPRAISMWGPLGG

SEQ ID NO: 755915 - protein, 815 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEAR

SEQ ID NO: 755916 - protein, 997 aa, Homo sapiens [sequence omitted]

SEQ ID NO: 755917 - protein, 990 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKRGGGGGRRSKKGGEFDEFVNDDTDDDLPISKKKKRRKGSGSEQEGEDEEGGERKKKKRRRPSKGKKFGFFEYPNGSKPKKPRRPINKG

SEQ ID NO: 755918 - protein, 1038 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKRGGGGGRRSKKGREVDEFGHGDTGDDPPLFQKKKRKKGVTKKAKKREVAGGKKKKSESLPKGENGLFVSKMKKARAIKNLSPKGTNKKGAKGQKVAPFGQGKIKNQALIPRRDGFWESDKFKFVLRAPGTGPGGPG

SEQ ID NO: 755919 - protein, 799 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAIETSKTRPSFRSFNSTY

SEQ ID NO: 755920 - protein, 139 aa, Homo sapiens
NSSGGRPILQVVSAWEGRCSRQRCRRLPLRELVRGSNFFPRLQCHIFSHGHPEGPDWKGEPAISRLGAPARLLVPMWPHPGCGSGGASGEGAGTRGRGPPRLGNGWLSESSGGPACPLLAGRPRWCRTRETLNLGPRNA

SEQ ID NO: 755921 - protein, 67 aa, Homo sapiens
NSSGGRPILQVVSAWEGRCSRQRCRRLPLRELVRGSNFFPRLQCHIFSHGHPEGPDWKGSQETMPAL

SEQ ID NO: 755922 - protein, 445 aa, Homo sapiens
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGR

SEQ ID NO: 755923 - protein, 375 aa, Homo sapiens
MYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGR

SEQ ID NO: 755924 - protein, 375 aa, Homo sapiens; identical to SEQ ID NO: 755923

SEQ ID NO: 755925 - protein, 280 aa, Homo sapiens
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMRRSFAVSSRLVS

SEQ ID NO: 755926 - protein, 375 aa, Homo sapiens; identical to SEQ ID NO: 755923

SEQ ID NO: 755927 - protein, 452 aa, Homo sapiens
LVANSARGLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGR

SEQ ID NO: 755928 - protein, 444 aa, Homo sapiens
MLLFVEQVASKGTGLNPNAKVWQEIAPGNTDATPVTHGTESSWHEIAATSGAHPEGNAELSEDICKEYEVMYSSSCETTRNTTGIEESTDGMILGPEDLSYQIYDVSGESNSAVSTEDLKECLKKQLEFCFSRENLSKDLYLISQMDSDQFIPIWTVANMEEIKKLTTDPDLILEVLRSSPMVQVDEKGEKVRPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQELTPQGFSNYTRPHGRYRTFYKQ

SEQ ID NO: 755929 - protein, 133 aa, Homo sapiens
MRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNG

SEQ ID NO: 755930 - protein, 189 aa, Homo sapiens
MQAAAFREEEASGCRPCLLPALMAGLRPPRDEETEAEAVQQLAQGHAAGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNG

SEQ ID NO: 755931 - protein, 178 aa, Homo sapiens
MDRAARCSGASSLPLLLALALGLVILHCVVADGNSTRSPETNGLLCGDPEENCAATTTQSKRKGHFSRCPKQYKHYCIKGRCRFVVAEQTPSCVCDEGYIGARCERVDLFYLRGDRGQILVICLIAVMVVFIILVIGVCTCCHPLRKRRKRKKKEEEMETLGKDITPINEDIEETNIA

SEQ ID NO: 755932 - protein, 129 aa, Homo sapiens
MDRAARCSGASSLPLLLALALGLVILHCVVADGNSTRSPETNGLLCGDPEENCAATTTQSKRKGHFSRCPKQYKHYCIKGRCRFVVAEQTPSCVPLRKRRKRKKKEEEMETLGKDITPINEDIEETNIA

SEQ ID NO: 755933 - protein, 110 aa, Homo sapiens
MDRAARCSGASSLPLLLALALGLVILHCVVADGNSTRSPETNGLLCGDPEENCAATSRISDAHLADTMIGKAVEHMFETEDGSKDEWRGMVLARAPVMNTWFYITYEKDP

SEQ ID NO: 755934 - protein, 176 aa, Homo sapiens
MLTSDEAAIGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 755935 - protein, 142 aa, Homo sapiens
MNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 755936 - protein, 176 aa, Homo sapiens; identical to SEQ ID NO: 755934

SEQ ID NO: 755937 - protein, 400 aa, Homo sapiens
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKATQMVAIVLGAFIVCWLPFFLTHVLNTHCQTCHVSPELYSATTWLGYVNSALNPVIYTTFNIEFRKAFLKILSC

SEQ ID NO: 755938 - protein, 342 aa, Homo sapiens
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSATSGEEGNPNGGHCAWGLHCLLAALLLDPCSQYPLPDMPRVPRALQCHDMAGLRE

SEQ ID NO: 755939 - protein, 553 aa, Homo sapiens
HPEGDSSLEPSLILVIPGSKSPPFPAQLSTSAATSKIPTLIMLFPISMSATEFLLASVIFCLVFWVIRASRPQVPKGLKNPPGPWGWPLIGHMLTLGKNPHLALSRMSQQYGDVLQIRIGSTPVVVLSGLDTIRQALVRQGDDFKGRPDLYTFTLISNGQSMSFSPDSGPVWAARRRLAQNGLKSFSIASDPASSTSCYLEEHVSKEAEVLISTLQELMAGPGHFNPYRYVVVSVTNVICAICFGRRYDHNHQELLSLVNLNNNFGEVVGSGNPADFIPILRYLPNPSLNAFKDLNEKFYSFMQKMVKEHYKTFEKGHIRDITDSLIEHCQEKQLDENANVQLSDEKIINIVLDLFGAGFDTVTTAISWSLMYLVMNPRVQRKIQEELDTVIGRSRRPRLSDRSHLPYMEAFILETFRHSSFVPFTIPHSTTRDTSLKGFYIPKGRCVFVNQWQINHDQKLWVNPSEFLPERFLTPDGAIDKVLSEKVIIFGMGKRKCIGETIARWEVFLFLAILLQRVEFSVPLGVKVDMTPIYGLTMKHACCEHFQMQLRS

SEQ ID NO: 755940 - protein, 553 aa, Homo sapiens; identical to SEQ ID NO: 755939

SEQ ID NO: 755941 - protein, 261 aa, Homo sapiens
EAKKGMLSGLPILEDTSLKFTNTSSNNQVSIDSLIEHCQEKQLDENANVQLSDEKIINIVLDLFGAGFDTVTTAISWSLMYLVMNPRVQRKIQEELDTVIGRSRRPRLSDRSHLPYMEAFILETFRHSSFVPFTIPHSTTRDTSLKGFYIPKGRCVFVNQWQINHDQKLWVNPSEFLPERFLTPDGAIDKVLSEKVIIFGMGKRKCIGETIARWEVFLFLAILLQRVEFSVPLGVKVDMTPIYGLTMKHACCEHFQMQLRS

SEQ ID NO: 755942 - protein, 198 aa, Homo sapiens
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSVRKPRYVRRERPLDRATDPAAFPGEARISNV

SEQ ID NO: 755943 - protein, 185 aa, Homo sapiens
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKGPAPAGSLPGRWSSQQFGPQAPALQPGEAVSNPHHPG

SEQ ID NO: 755944 - protein, 255 aa, Homo sapiens
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSDVGSAGKEDPHDRADPQYLLLLEVQLHPRTDAAGLRQALLSSHRFSGAGSGGPKSQPVRKPRYVRRERPLDRATDPAAFPGEARISNV

SEQ ID NO: 755945 - protein, 185 aa, Homo sapiens; identical to SEQ ID NO: 755943

SEQ ID NO: 755946 - protein, 198 aa, Homo sapiens; identical to SEQ ID NO: 755942

SEQ ID NO: 755947 - protein, 130 aa, Homo sapiens [sequence omitted]

SEQ ID NO: 755948 - protein, 197 aa, Homo sapiens
MSVVPILEGQPHSISLAPHAPPCGRLCASAPGMALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAVSNPHHPG

SEQ ID NO: 755949 - protein, 165 aa, Homo sapiens
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAVSNPHHPG

SEQ ID NO: 755950 - protein, 61 aa, Homo sapiens
MSVVPILEGQVRPCLHLAPPVPPKAPSLHSFTPPPFGSTFPVVALHPCHGPAPSPFNSVIC

SEQ ID NO: 755951 - protein, 87 aa, Homo sapiens
MVAVVDGAAETWWPWWMVLRHGGCGERCCRDMVAVVDGAAETWWLWWTVPRHGGRGGWCRDMVAVVNNAAADMVAVVNGAAETWWLW

SEQ ID NO: 755952 - protein, 124 aa, Homo sapiens
MRPQSFRSRPWGVRAPPGNTVRPQRLQPKLARSMGQVPLCLEKPGALLPCPPEPTAGRTPPAPPHPVARDPSENSEAGPRAVPAGARPVGRTQPRNQLPETRVPLGCPPAWRRPQARSHPFPEL

SEQ ID NO: 755953 - protein, 225 aa, Homo sapiens
KPASCDKAQDPSLPQLLAVLSFLGSKDPGVWVHSLLLSEIQESDQQPLPPPGPRSPELIPMELCRSLALLGGSLGLMFCLIALSTDFWFEAVGPTHSAHSGLWPTGHGDIISGYIHVTQTFSIMAVLWALVSVSFLVLSCFPSLFPPGHGPLVSTTAAFAAAISMVVAMAVYTSERWDQPPHPQIQTFFSWSFYLGWVSAILLLCTGALSLGAHCGGPRPGYETL

SEQ ID NO: 755954 - protein, 202 aa, Homo sapiens
KPASCDKAQDPSLPQLLAVLSFLGSKDPGVWVHSLLLSEIQESDQQPLPPPGPRSPELIPMELCRSLALLGGSLGLMFCLIALSTDFWFEAVGPTHSAHSGLWPTGHGDIISGHGPLVSTTAAFAAGKDSGLDWGIASQRIPAEELSHLSCPCPQPSPWWWPWRCTPASGGTSLHTPRSRPSSPGPSTWAGSQLSSCSVQVP

SEQ ID NO: 755955 - protein, 190 aa, Homo sapiens
KPASCDKAQDPSLPQLLAVLSFLGSKDPGVWVHSLLLSEIQESDQQPLPPPGPRSPELIPMELCRSLALLGGSLGLMFCLIALSTDFWFEAVGPTHSAHSGLWPTGHGDIISGHGPLVSTTAAFAAAISMVVAMAVYTSERWDQPPHPQIQTFFSWSFYLGWVSAILLLCTGALSLGAHCGGPRPGYETL

SEQ ID NO: 755956 - protein, 176 aa, Homo sapiens
KPASCDKAQDPSLPQLLAVLSFLGSKDPGVWVHSLLLSEIQESDQQPLPPPGPRSPELIPMELCRSLALLGGSLGLMFCLIALSTDFWFEAVGPTHSAHSGLWPTGHGDIISAISMVVAMAVYTSERWDQPPHPQIQTFFSWSFYLGWVSAILLLCTGALSLGAHCGGPRPGYETL

SEQ ID NO: 755957 - protein, 148 aa, Homo sapiens
KPASCDKAQDPSLPQLLAVLSFLGSKDPGVWVHSLLLSEIQESDQQPLPPPGPRSPELIPMELCRSLALLGGSLGLMFCLIALSTDFWFEAVGPTHSAHSGLWPTGHGDIISDLLLLVLLPGLGLSYPLALYRCPEPGCSLWRSPSWL

SEQ ID NO: 755958 - protein, 190 aa, Homo sapiens
RGPARSLWPLILRAPECAAGSSLQPRRVLAPRDRPGRPTNGVPAPRLLLHAFGSHGSGGLCMGQWATRCKANRVLPRRARELHASDSSWCTFPLFLSGGGALWVPGRSSRANRKALRAEWGGTEARKGRPNWSVRKVLGRGGEAASGGLAPPAVAMVTERAQLSVGASTGVLCCPSMGDQLRWEPVVSHT

SEQ ID NO: 755959 - protein, 190 aa, Homo sapiens; identical to SEQ ID NO: 755958

SEQ ID NO: 755960 - protein, 63 aa, Homo sapiens
PELCGAPETSRNAWKTSIMSVLSFPVFKQAILETPHFAGNKNPSSGRDVRDVSFLCGFALVVY

SEQ ID NO: 755961 - protein, 410 aa, Homo sapiens
MGTCWGDISENVRVEVPNTDCSLPTKVFWIAGIVKLAGYNALLRYEGFENDSGLDFWCNICGSDIHPVGWCAASGKPLVPPRTIQHKYTNWKAFLVKRLTGAKTLPPDFSQKVSESMQYPFKPCMRVEVVDKRHLCRTRVAVVESVIGGRLRLVYEESEDRTDDFWCHMHSPLIHHIGWSRSIGHRFKRSDITKKQDGHFDTPPHLFAKVKEVDQSGEWFKEGMKLEAIDPLNLSTICVATIRKVLADGFLMIGIDGSEAADGSDWFCYHATSPSIFPVGFCEINMIELTPPRGYTKLPFKWFDYLRETGSIAAPVKLFNKDVPNHGFRVGMKLEAVDLMEPRLICVATVTRIIHRLLRIHFDGWEEEYDQWVDCESPDLYPVGWCQLTGYQLQPPASQCKLVYRKGVLL

SEQ ID NO: 755962 - protein, 132 aa, Homo sapiens
CLSHSTADSEEHQEPAWGRTQGQSSIGGVMTTTASAKAVITTPIQTKRVSPRPVEMAGADTFQLSVGSWAECFTCIISFRPPTPARGVISITILQMKRLRLGEVREHIQGHPVNNVHLIHFTLISQLVSAGH

SEQ ID NO: 755963 - protein, 76 aa, Homo sapiens
AVGAGSGMYSLVAPALALHPMHSRCLASASGGSFDGPAGLSGSGGRHWESRSVPHTISSAACVFLPFAVALPMASD

SEQ ID NO: 755964 - protein, 134 aa, Homo sapiens
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 755965 - protein, 326 aa, Homo sapiens
MNTMYVMMAQILRSHLIKATVIPNRVKMLPYFGIIRNRMMSTHKSKKKIREYYRLLNVEEGCSADEVRESFHKLAKQYHPDSGSNTADSATFIRIEKAYRKVLSHVIEQTNASQSKGEEEEDVEKFKYKTPQHRHYLSFEGIGFGTPTQREKHYRQFRADRAAEQVMEYQKQKLQSQYFPDSVIVKNIRQSKQQKITQAIERLVEDLIQESMAKGDFDNLSGKGKPLKKFSDCSYIDPMTHNLNRILIDNGYQPEWILKQKEISDTIEQLREAILVSRKKLGNPMTPTEKKQWNHVCEQFQENIRKLNKRINDFNCSHPDQAKSPF

SEQ ID NO: 755966 - protein, 326 aa, Homo sapiens; identical to SEQ ID NO: 755965

SEQ ID NO: 755967 - protein, 326 aa, Homo sapiens; identical to SEQ ID NO: 755965

SEQ ID NO: 755968 - protein, 810 aa, Homo sapiens
MIPVTELRYFADTQPAYRILKPWWDVFTDYISIVMLMIAVFGGTLQVTQDKMICLPCKWVTKDSCNDSFRGWAAPGPEPTYPNSTILPTPDTGPTGIKYDLDRHQYNYVDAVCYENRLHWFAKYFPYLVLLHTLIFLACSNFWFKFPRTSSKLEHFVSILLKCFDSPWTTRALSETVVEESDPKPAFSKMNGSMDKKSSTVSEDVEATVPMLQRTKSRIEQGIVDRSETGVLDKKEGEQAKALFEKVKKFRTHVEEGDIVYRLYMRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRIETLPPELFQCRKLRALHLGNNVLQSLPSRVGELTNLTQIELRGNRLECLPVELGECPLLKRSGLVVEEDLFNTLPPEVKERLWRADKEQA

SEQ ID NO: 755969 - protein, 297 aa, Homo sapiens
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQTLARSLGLQMPVVVQSMYIFKSPLIRTPPSCTRSPWAGCWACGSQWRMPRWRTAVSGSSLAPTPVVCQEGWSGPLLAQRLVPASLGQSQPGITASLCPPQCREGPWSSSMEKWYTRASRTSLTARARPTLSTSWRPLAPPGARRTGSSQQLNCPFPNCTPKGSRRAGALAPPG

SEQ ID NO: 755970 - protein, 810 aa, Homo sapiens; identical to SEQ ID NO: 755968

SEQ ID NO: 755971 - protein, 810 aa, Homo sapiens; identical to SEQ ID NO: 755968

SEQ ID NO: 755972 - protein, 810 aa, Homo sapiens; identical to SEQ ID NO: 755968

SEQ ID NO: 755973 - protein, 810 aa, Homo sapiens; identical to SEQ ID NO: 755968

SEQ ID NO: 755974 - protein, 810 aa, Homo sapiens; identical to SEQ ID NO: 755968

SEQ ID NO: 755975 - protein, 810 aa, Homo sapiens; identical to SEQ ID NO: 755968

SEQ ID NO: 755976 - protein, 324 aa, Homo sapiens
TDELNPRRNSGTEQSFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRIETLPPELFQCRKLRALHLGNNVLQSLPSRVGELTNLTQIELRGNRLECLPVELGECPLLKRSGLVVEEDLFNTLPPEVKERLWRADKEQA

SEQ ID NO: 755977 - protein, 810 aa, Homo sapiens; identical to SEQ ID NO: 755968

SEQ ID NO: 755978 - protein, 733 aa, Homo sapiens
MIPVTELRYFADTQPAYRILKPWWDVFTDYISIVMLMIAVFGGTLQVTQDKMICLPCKWVTKDSCNDSFRGWAAPGPEPTYPNSTILPTPDTGPTGIKYDLDRHQYNYVDAVCYENRLHWFAKYFPYLVLLHTLIFLACSNFWFKFPRTSSKLEHFVSILLKCFDSPWTTRALSETVVEESDPKPAFSKMNGSMDKKSSTVSEDVEATVPMLQRTKSRIEQGIVDRSETGVLDKKEGEQAKALFEKVKKFRTHVEEGDIVYRLYMRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRHLHRLTCLSCVRLR

SEQ ID NO: 755979 - protein, 702 aa, Homo sapiens
MIPVTELRYFADTQPAYRILKPWWDVFTDYISIVMLMIAVFGGTLQVTQDKMICLPCKWVTKDSCNDSFRGWAAPGPEPTYPNSTILPTPDTGPTGIKYDLDRHQYNYVDAVCYENRLHWFAKYFPYLVLLHTLIFLACSNFWFKFPRTSSKLEHFVSILLKCFDSPWTTRALSETVVEESDPKPAFSKMNGSMDKKSSTVSEDVEATVPMLQRTKSRIEQGIVDRSETGVLDKKEGEQAKALFEKVKKFRTHVEEGDIVYRLYMRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSLVSMGSSKS

SEQ ID NO: 755980 - protein, 291 aa, Homo sapiens
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQTLARSLGLQMPVVVQSMYIFKQPHFGGEVSPHQDASFLYTEPLGRVLGVWIAVEDATLENGCLWFIPGSHTSGVSRRMVRAPVGSAPGTSFLGSEPARDNSLFVPTPVQRGALVLIHGEVVHKSKQNLSDRSRQAYTFHLMEASGTTWSPENWLQPTAELPFPQLYT

SEQ ID NO: 755981 - protein, 114 aa, Homo sapiens
ELGTQRLNGEIGTLLHCWWECKLVQPLWKTVWQFLKDLEPEIPFDPAIPLLGSQRNINHPSASVRGWSGMGRSPLGGQALVPSRFPSLAPGVHTAQSAPGGWKPPCFRSLGSPP

SEQ ID NO: 755982 - protein, 291 aa, Homo sapiens; identical to SEQ ID NO: 755980

SEQ ID NO: 755983 - protein, 270 aa, Homo sapiens
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQQPHFGGEVSPHQDASFLYTEPLGRVLGVWIAVEDATLENGCLWFIPGSHTSGVSRRMVRAPVGSAPGTSFLGSEPARDNSLFVPTPVQRGALVLIHGEVVHKSKQNLSDRSRQAYTFHLMEASGTTWSPENWLQPTAELPFPQLYT

SEQ ID NO: 755984 - protein, 112 aa, Homo sapiens
MGSSLGAAGSRSLGKRPSPGDGRARVAWGTQRNVLSIWSPAVILGFSYCVLLQGLSNPQNSLSFLPPVSFSASEIRTICVTPTLNFRKTCIMWCNQTRGFSDDLLTSSMWIR

SEQ ID NO: 755985 - protein, 1738 aa, Homo sapiens
MKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 755986 - protein, 1829 aa, Homo sapiens
PAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 755987 - protein, 1046 aa, Homo sapiens
MLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 755988 - protein, 734 aa, Homo sapiens [sequence omitted]

SEQ ID NO: 755989 - protein, 760 aa, Homo sapiens
MKSGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 755990 - protein, 1811 aa, Homo sapiens
PAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 755991 - protein, 1555 aa, Homo sapiens
PAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKHIDHDLQFRARIQSTCSM

SEQ ID NO: 755992 - protein, 1524 aa, Homo sapiens
PAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKQEAAILQKQAEAGRGILW

SEQ ID NO: 755993 - protein, 115 aa, Homo sapiens
CPAAVCIPIADTRGFTNVVHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 755994 - protein, 762 aa, Homo sapiens
PAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGTVCFPPFFL

SEQ ID NO: 755995 - protein, 387 aa, Homo sapiens
PAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLER

SEQ ID NO: 755996 - protein, 70 aa, Homo sapiens
RRGALGDRGNMAEYTRLHNALALIRLRNPPVNAISTTLLRDIKEGLQKAVIDHTNSSLTLSHHLWNPATD

SEQ ID NO: 755997 - protein, 733 aa, Homo sapiens
RRGALGDRGNMAEYTRLHNALALIRLRNPPVNAISTTLLRDIKEGLQKAVIDHTIKAIVICGAEGKFSAGADIRGFSAPRTFGLTLGHVVDEIQRNEKPVVAAIQGMAFGGGLELALGCHYRIAHAEAQVGLPEVTLGLLPGARGTQLLPRLTGVPAALDLITSGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVGLGTMGRGIVISFARARIPVIAVDSDKNQLATANKMITSVLEKEASKMQQSGHPWSGPKPRLTSSVKELGGVDLVIEAVFEEMSLKKQVFAELSAVCKPEAFLCTNTSALDVDEIASSTDRPHLVIGTHFFSPAHVMKLLEVIPSQYSSPTTIATVMNLSKKIKKIGVVVGNCFGFVGNRMLNPYYNQAYFLLEEGSKPEEVDQVLEEFGFKMGPFRVSDLAGLDVGWKSRKGQGLTGPTLLPGTPARKRGNRRYCPIPDVLCELGRFGQKTGKGWYQYDKPLGRIHKPDPWLSTFLSRYRKTHHIEPRTISQDEILERCLYSLINEAFRILGEGIAASPEHIDVVYLHGYGWPRHKGGPMFYASTVGLPTVLEKLQKYYRQNPDIPQLEPSDYLKKLASQGNPPLKEWQSLAGSPSSKL

SEQ ID NO: 755998 - protein, 729 aa, Homo sapiens
RRGALGDRGNMAEYTRLHNALALIRLRNPPVNAISTTLLRDIKEGLQKAVIDHTSADIRGFSAPRTFGLTLGHVVDEIQRNEKPVVAAIQGMAFGGGLELALGCHYRIAHAEAQVGLPEVTLGLLPGARGTQLLPRLTGVPAALDLITSAFKVEMTLQIHGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVGLGTMGRGIVISFARARIPVIAVDSDKNQLATANKMITSVLEKEASKMQQSGHPWSGPKPRLTSSVKELGGVDLVIEAVFEEMSLKKQVFAELSAVCKPEAFLCTNTSALDVDEIASSTDRPHLVIGTHFFSPAHVMKLLEVIPSQYSSPTTIATVMNLSKKIKKIGVVVGNCFGFVGNRMLNPYYNQAYFLLEEGSKPEEVDQVLEEFGFKMGPFRVSDLAGLDVGWKSRKGQGLTGPTLLPGTPARKRGNRRYCPIPDVLCELGRFGQKTGKGWYQYDKPLGRIHKPDPWLSTFLSRYRKTHHIEPRTISQDEILERCLYSLINEAFRILGEGIAASPEHIDVVYLHGYGWPRHKGGPMFYASTVGLPTVLEKLQKYYRQNPDIPQLEPSDYLKKLASQGNPPLKEWQSLAGSPSSKL

SEQ ID NO: 755999 - protein, 715 aa, Homo sapiens
RRGALGDRGNMAEYTRLHNALALIRLRNPPVNAISTTLLRDIKEGLQKAVIDHTIKAIVICGAEGKFSAGADIRGFSAPRTFGLTLGHVVDEIQRNEKPVVAAIQGMAFGGGLELALGCHYRIAHAEAQVGLPEVTLGLLPGARGTQLLPRLTGVPAALDLITSGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVGLGTMGRGIVISFARARIPVIAVDSDKNQLATANKMITSVLEKEASKMQQSGHPWSGPEAVFEEMSLKKQVFAELSAVCKPEAFLCTNTSALDVDEIASSTDRPHLVIGTHFFSPAHVMKLLEVIPSQYSSPTTIATVMNLSKKIKKIGVVVGNCFGFVGNRMLNPYYNQAYFLLEEGSKPEEVDQVLEEFGFKMGPFRVSDLAGLDVGWKSRKGQGLTGPTLLPGTPARKRGNRRYCPIPDVLCELGRFGQKTGKGWYQYDKPLGRIHKPDPWLSTFLSRYRKTHHIEPRTISQDEILERCLYSLINEAFRILGEGIAASPEHIDVVYLHGYGWPRHKGGPMFYASTVGLPTVLEKLQKYYRQNPDIPQLEPSDYLKKLASQGNPPLKEWQSLAGSPSSKL

SEQ ID NO: 756000 - protein, 177 aa, Homo sapiens
RRGALGDRGNMAEYTRLHNALALIRLRNPPVNAISTTLLRDIKEGLQKAVIDHTIKAIVICGAEGKFSAGADIRGFSAPRTFGLTLGHVVDEIQRNEKPVVAAIQGMAFGGGLELALGCHYRIAHAEAQVGLPEVTLGLLPGARGTQLLPRLTGVPAALDLITSGQYRPWQQLSRLV

SEQ ID NO: 756001 - protein, 733 aa, Homo sapiens; identical to SEQ ID NO: 755997

SEQ ID NO: 756002 - protein, 733 aa, Homo sapiens; identical to SEQ ID NO: 755997

SEQ ID NO: 756003 - protein, 733 aa, Homo sapiens; identical to SEQ ID NO: 755997

SEQ ID NO: 756004 - protein, 367 aa, Homo sapiens
RRGALGDRGNMAEYTRLHNALALIRLRNPPVNAISTTLLRDIKEGLQKAVIDHTIKAIVICGAEGKFSAGADIRGFSAPRTFGLTLGHVVDEIQRNEKPVVAAIQGMAFGGGLELALGCHYRIAHAEAQVGLPEVTLGLLPGARGTQLLPRLTGVPAALDLITSGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVDSMTLLCLLTETRLTLRTCICCPLQGMLPLLPHSMDSWVTSQTIALYGTLSFVV

SEQ ID NO: 756005 - protein, 142 aa, Homo sapiens
MATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 756006 - protein, 200 aa, Homo sapiens
SRKCYRSCSVYVLLEACIPSPPPPARAPSARTRRAPIPAAGQGRARPPRTVSRCGSAAMATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 756007 - protein, 142 aa, Homo sapiens; identical to SEQ ID NO: 756005

SEQ ID NO: 756008 - protein, 85 aa, Homo sapiens
LPAVIRRPKPLPVVLCFHGHAPCPLSCSSRTPGSSLKFLEDSGRRNSENLKVFDRISDKCTEENADVCCLPSLLQLPKRKGTPVL

SEQ ID NO: 756009 - protein, 685 aa, Homo sapiens
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 756010 - protein, 142 aa, Homo sapiens
MNVSLPRRYKAGAYLDIPAQPRGWTFLLHCLHCILDGTFFICNVLLSGGGGNGRNRTDCELAKRCNTLPHLWVSVWHQIGSCTNQRNRREESVLEIPLRGKSGAAAAWALSSLKPISTTSSLGSGPLLPQTTLKAGLQKSII

SEQ ID NO: 756011 - protein, 685 aa, Homo sapiens; identical to SEQ ID NO: 756009

SEQ ID NO: 756012 - protein, 181 aa, Homo sapiens [sequence omitted]

SEQ ID NO: 756013 - protein, 102 aa, Homo sapiens
NWAQFGPLGPPPFCPKVKWALFKGGAPSGAPACFPERVAVAPWGPELLWPPLASVFPKVPLAQAPRRQLGPNQKGERGPMRAGPPVGWKTTGCVSCWGLPWR

SEQ ID NO: 756014 - protein, 600 aa, Homo sapiens
MAGVIWITGLIGWLITIITAKKDIGQPSLAPLGTGDPSLTRPSAPSEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 756015 - protein, 470 aa, Homo sapiens
HFHNLLAKVMQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 756016 - protein, 470 aa, Homo sapiens; identical to SEQ ID NO: 756015

SEQ ID NO: 756017 - protein, 451 aa, Homo sapiens
HFHNLLAKVMQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLASQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 756018 - protein, 451 aa, Homo sapiens
HFHNLLAKVMQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVILLKLKPFWITSLKAPNHLMTSLGLLVEKMPNQVNSLWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 756019 - protein, 103 aa, Homo sapiens
HFHNLLAKVMQRVNMIMAESPGLITICLLGYLLSAECTVFLDHENANKILNRPKRYNSGKLEEFVQGNLERECMEEKCSFEEAREVFENTERTMEISVSPIHV

SEQ ID NO: 756020 - protein, 89 aa, Homo sapiens
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 756021 - protein, 268 aa, Homo sapiens
MSGKANASKKNAQQLKRNPKRKKDNEEVVLSENKVRNTVKKNKNHLKDLSSEGQTKHTNLKHGKTAASKRKTWQPLSKSTRDHLQTMMESVIMTILSNSIKEKEEIQYHLNFLKKRLLQQCETLKVPPKKMEDLTNVSSLLNMERARDKANEEGLALLQEEIDKMVETTELMTGNIQSLKNKIQILASEVEEEEERVKQMHQINSSGVLSLPELSQKTLKAPTLQKEILALIPNQNALLKDLDILHNSSQMKSMSTFIEEAYKKLDAS

SEQ ID NO: 756022 - protein, 247 aa, Homo sapiens
MSGKANASKKNAQQLKRNPKRKKDNEEVVLSENKVRNTVKKNKNHLKDLSSEGQTKHTNLKHGKTAASKRKTWQPLSKSTRDHLQTMMESVIMTILSNSIKEKEEIQYHLNFLKKRLLQQCETLKVPPKKMEDLTNVSSLLNMERARDKANEEGLALLQNKIQILASEVEEEEERVKQMHQINSSGVLSLPELSQKTLKAPTLQKEILALIPNQNALLKDLDILHNSSQMKSMSTFIEEAYKKLDAS

SEQ ID NO: 756023 - protein, 143 aa, Homo sapiens
MSGKANASKKNAQQLKRNPKRKKDNEEVVLSENKVRNTVKKNKNHLKDLSSEGQTKHTNLKHGKTAASKRKTWQPLSKSTRDHLQTMMESVIMTILSNSIKEKEEIQYHLNFLKKSLLSLVPEVTIPKIQLLLPIQQSTTLAN

SEQ ID NO: 756024 - protein, 268 aa, Homo sapiens; identical to SEQ ID NO: 756021

SEQ ID NO: 756025 - protein, 46 aa, Homo sapiens
WGLLEARGHVLFISGPPSPAPVFLTPSQDPVHKKCELLSQLWLSLD

SEQ ID NO: 756026 - protein, 131 aa, Homo sapiens
VFKVHKCAVCGFTTENLLQFHEHIPQHKSDGSFYQCRECGLCYMSRLSVQAPLFVHKLKEPQPVSKQNGAGEDNQQENKPSHEDESPNGAMSDRKCKVCAKTFETEAALNTHMQTHGMAFIKSKRMSSDEK

SEQ ID NO: 756027 - protein, 543 aa, Homo sapiens
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 756028 - protein, 543 aa, Homo sapiens; identical to SEQ ID NO: 756027

SEQ ID NO: 756029 - protein, 543 aa, Homo sapiens; identical to SEQ ID NO: 756027

SEQ ID NO: 756030 - protein, 499 aa, Homo sapiens
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGMVNREVLEQVERGYRMPCPQGCPESLHELMNLCWKKDPDERPTFEYIQSFLEDYFTATEPQYQPGENL

SEQ ID NO: 756031 - protein, 543 aa, Homo sapiens; identical to SEQ ID NO: 756027

SEQ ID NO: 756032 - protein, 543 aa, Homo sapiens; identical to SEQ ID NO: 756027

SEQ ID NO: 756033 - protein, 543 aa, Homo sapiens; identical to SEQ ID NO: 756027

SEQ ID NO: 756034 - protein, 600 aa, Homo sapiens
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGRQSKTPSQKDKKNLPGIMVAPVVSELRGLKGEHHWGPGSRPRREMANDSPMTMNLQKKGG

SEQ ID NO: 756035 - protein, 306 aa, Homo sapiens
IISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEY

SEQ ID NO: 756036 - protein, 1101 aa, Homo sapiens
RCSGWRSAAEVRAGPAPPPVSPPPTPQPLPLPQPHEAPHRALRRCGPGSALHARSPRRHQPSMHQKTPEIYSVELSGTKDIVKTDKGDGKEKYRGLKNNCLELKKKNHKEEFQKELHLDDHKLSNRELEEKYGTDIIMGLSSTRAAELLARDGPNSLTPPKQTPEIVKFLKQMVGGFSILLWVGAFLCWIAYGIQYSSDKSASLNNVYLGCVLGLVVILTGIFAYYQEAKSTNIMSSFNKMIPQQALVIRDSEKKTIPSEQLVVGDIVEVKGGDQIPADIRVLSSQGCRVDNSSLTGESEPQPRSSEFTHENPLETKNICFYSTTCLEGTVTGMVINTGDRTIIGHIASLASGVGNEKTPIAIEIEHFVHIVAGVAVSIGILFFIIAVSLKYQVLDSIIFLIGIIVANVPEGLLATVTVTLSLTAKRMAKKNCLVKNLEAVETLGSTSIICSDKTGTLTQNRMTVAHLWFDNQIFVADTSEDHSNQVFDQSSRTWASLSKIITLCNRAEFKPGQENVPIMKKAVIGDASETALLKFSEVILGDVMEIRKRNRKVAEIPFNSTNKFQLSIHEMDDPHGKRFLMVMKGAPERILEKCSTIMINGEEHPLDKSTAKTFHTAYMELGGLGERVLGFCHLYLPADEFPETYSFDIDAMNFPTSNLCFVGLLSMIDPPRSTVPDAVTKCRSAGIKVIMVTGDHPITAKAIAKSVGIISANSETVEDIAHRLNIAVEQVNKRDAKAAVVTGMELKDMSSEQLDEILANYQEIVFARTSPQQKLIIVEGCQRQDAVVAVTGDGVNDSPALKKADIGIAMGIAGSDAAKNAADMVLLDDNFASIVTGVEEGRLIFDNLKKTIAYSLTKNIAELCPFLIYIIVGLPLPIGTITILFIDLGTDIIPSIALAYEKAESDIMNRKPRHKNKDRLVNQPLAVYSYLHIGLMQALGAFLVYFTVYAQEGFLPRTLINLRVEWEKDYVNDLKDSYGQEWTRYQREYLEWTGYTAFFVGILVQQIADLIIRKTRRNSIFQQGLFRNKVIWVGITSQIIIGLILSYGLGSVTALSFTMLRAQYWFVAVPHAILIWVYDEVRKLFIRLYPGSWWDKNMYY

SEQ ID NO: 756037 - protein, 126 aa, Homo sapiens
TWAGRAAFKAGATSPVQRLAIGRGGACRARAAAGISTANTSATATATATRGPPPCAPPLRSRIRAPRPQPAAPPAQHAPGACSPRAGRGCETLGQGPGDRSRLTGSEEKAKRRNAPSRGKGRPPFL

SEQ ID NO: 756038 - protein, 360 aa, Homo sapiens
MEECWVTEIANGSKDGLDSNPMKDYMILSGPQKTAVAVLCTLLGLLSALENVAVLYLILSSHQLRRKPSYLFIGSLAGADFLASVVFACSFVNFHVFHGVDSKAVFLLKIGSVTMTFTASVGSLLLTAIDRYLCLRYPPSYKALLTRGRALVTLGIMWVLSALVSYLPLMGWTCCPRPCSELFPLIPNDYLLSWLLFIAFLFSGIIYTYGHVLWKAHQHVASLSGHQDRQVPGMARMRLDVRLAKTLGLVLAVLLICWFPVLALMAHSLATTLSDQVKKAFAFCSMLCLINSMVNPVIYALRSGEIRSSAHHCLAHWKKCVRGLGSEAKEEAPRSSVTETEADGKITPWPDSRDLDLSDC

SEQ ID NO: 756039 - protein, 360 aa, Homo sapiens; identical to SEQ ID NO: 756038

SEQ ID NO: 756040 - protein, 360 aa, Homo sapiens; identical to SEQ ID NO: 756038

SEQ ID NO: 756041 - protein, 360 aa, Homo sapiens; identical to SEQ ID NO: 756038

SEQ ID NO: 756042 - protein, 360 aa, Homo sapiens; identical to SEQ ID NO: 756038

SEQ ID NO: 756043 - protein, 304 aa, Homo sapiens
MIQNSRPSLLQPQDVGDTVETLMLHPVIKAFLCGSISGTCSTLLFQPLDLLKTRLQTLQPSDHGSRRVGMLAVLLKVVRTESLLGLWKGMSPSIVRCVPGVGIYFGTLYSLKQYFLRGHPPTALESVMLGVGSRSVAGVCMSPITVIKTRYESGKYGYESIYAALRSIYHSEGHRGLFSGLTATLLRDAPFSGIYLMFYNQTKNIVPHDQVDATLIPITNFSCGIFAGILASLVTQPADVIKTHMQLYPLKFQWIGQAVTLIFKDYGLRGFFQGGIPRALRRTLMAAMAWTVYEEMMAKMGLKS

SEQ ID NO: 756044 - protein, 304 aa, Homo sapiens; identical to SEQ ID NO: 756043

SEQ ID NO: 756045 - protein, 304 aa, Homo sapiens; identical to SEQ ID NO: 756043

SEQ ID NO: 756046 - protein, 304 aa, Homo sapiens; identical to SEQ ID NO: 756043

SEQ ID NO: 756047 - protein, 235 aa, Homo sapiens
MLAVLLKVVRTESLLGLWKGMSPSIVRCVPGVGIYFGTLYSLKQYFLRGHPPTALESVMLGVGSRSVAGVCMSPITVIKTRYESGKYGYESIYAALRSIYHSEGHRGLFSGLTATLLRDAPFSGIYLMFYNQTKNIVPHDQVDATLIPITNFSCGIFAGILASLVTQPADVIKTHMQLYPLKFQWIGQAVTLIFKDYGLRGFFQGGIPRALRRTLMAAMAWTVYEEMMAKMGLKS

SEQ ID NO: 756048 - protein, 304 aa, Homo sapiens; identical to SEQ ID NO: 756043

SEQ ID NO: 756049 - protein, 298 aa, Homo sapiens
MACTREAKYEENMRHHQLHPVIKAFLCGSISGTCSTLLFQPLDLLKTRLQTLQPSDHGSRRVGMLAVLLKVVRTESLLGLWKGMSPSIVRCVPGVGIYFGTLYSLKQYFLRGHPPTALESVMLGVGSRSVAGVCMSPITVIKTRYESGKYGYESIYAALRSIYHSEGHRGLFSGLTATLLRDAPFSGIYLMFYNQTKNIVPHDQVDATLIPITNFSCGIFAGILASLVTQPADVIKTHMQLYPLKFQWIGQAVTLIFKDYGLRGFFQGGIPRALRRTLMAAMAWTVYEEMMAKMGLKS

SEQ ID NO: 756050 - protein, 286 aa, Homo sapiens
MRHHQLHPVIKAFLCGSISGTCSTLLFQPLDLLKTRLQTLQPSDHGSRRVGMLAVLLKVVRTESLLGLWKGMSPSIVRCVPGVGIYFGTLYSLKQYFLRGHPPTALESVMLGVGSRSVAGVCMSPITVIKTRYESGKYGYESIYAALRSIYHSEGHRGLFSGLTATLLRDAPFSGIYLMFYNQTKNIVPHDQVDATLIPITNFSCGIFAGILASLVTQPADVIKTHMQLYPLKFQWIGQAVTLIFKDYGLRGFFQGGIPRALRRTLMAAMAWTVYEEMMAKMGLKS

SEQ ID NO: 756051 - protein, 244 aa, Homo sapiens
MIQNSRPSLLQPQDVGDTVETLMLHPVIKAFLCGSISGTCSTLLFQPLDLLKTRLQTLQPSDHGSRRVGMLAVLLKVVRTESLLGLWKGMSPSGKYGYESIYAALRSIYHSEGHRGLFSGLTATLLRDAPFSGIYLMFYNQTKNIVPHDQVDATLIPITNFSCGIFAGILASLVTQPADVIKTHMQLYPLKFQWIGQAVTLIFKDYGLRGFFQGGIPRALRRTLMAAMAWTVYEEMMAKMGLKS

SEQ ID NO: 756052 - protein, 304 aa, Homo sapiens; identical to SEQ ID NO: 756043

SEQ ID NO: 756053 - protein, 304 aa, Homo sapiens; identical to SEQ ID NO: 756043

SEQ ID NO: 756054 - protein, 304 aa, Homo sapiens; identical to SEQ ID NO: 756043

SEQ ID NO: 756055 - protein, 288 aa, Homo sapiens
MIQNSRPSLLQPQDVGDTVETLMLHPVIKAFLCGSISGTCSTLLFQPLDLLKTRLQTLQPSDHGSRRVGMLAVLLKSIVRCVPGVGIYFGTLYSLKQYFLRGHPPTALESVMLGVGSRSVAGVCMSPITVIKTRYESGKYGYESIYAALRSIYHSEGHRGLFSGLTATLLRDAPFSGIYLMFYNQTKNIVPHDQVDATLIPITNFSCGIFAGILASLVTQPADVIKTHMQLYPLKFQWIGQAVTLIFKDYGLRGFFQGGIPRALRRTLMAAMAWTVYEEMMAKMGLKS

SEQ ID NO: 756056 - protein, 287 aa, Homo sapiens
FGLRSGRVYSPPPPRPRGPRHRTSGGARPRLPRHSRTGSLLAGAGPGLAALVTMSETSFNLISEKCDILSILRDHPENRIYRRKIEELSKRFTAIRKTKGDGNCFYRALGYSYLESLLGKSREIFKFKERVLQTPNDLLAAGFEEHKFRNFFNAFYSVVELVEKDGSVSSLLKVFNDQSASDHIVQFLRLLTSAFIRNRADFFRHFIDEEMDIKDFCTHEVEPMATECDHIQITALSQALSIALQVEYVDEMDTALNHHVFPEAATPSVYLLYKTSHYNILYAADKH

SEQ ID NO: 756057 - protein, 155 aa, Homo sapiens
MHTHTMQLSHQGPAGPGWRCARCMWLCVGGRGGRFCGWTRDEVGGRSGLRGGRTVANHSTLAVFPCKHSVFPLCRFKERVLQTPNDLLAAGFEEHKFRNFFNAVSSPGPSFHTGRADRSGHWLEPLHSPQLCSSWLGKDRGFLPACGGVWAQGAL

SEQ ID NO: 756058 - protein, 225 aa, Homo sapiens
FGLRSGRVYSPPPPRPRGPRHRTSGGARPRLPRHSRTGSLLAGAGPGLAALVTMSETSFNLISEKCDILSILRDHPENRIYRRKIEELSKRFTAIRKTKGDGNCFYRALGYSYLESLLGKSREIFKWCRGPLACQGCVLCARSASSLSEVFVTLRLVNPENELKSCLAEAFDVGGAQLPAVVKLGAAKGWRMESVTSQMLSSLCFHHRPGSAQVSRREQVLRDPL

SEQ ID NO: 756059 - protein, 287 aa, Homo sapiens; identical to SEQ ID NO: 756056

SEQ ID NO: 756060 - protein, 347 aa, Homo sapiens
IASSSRGIGSHCKSEGQEESFVPQSSVQPPEGDSETKAPEESSEDATKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRFNIRGTTIGDRIMRRSAVARIQEFFRRRKERKEMEELDTLNIRRPLVKMVYKGHRNSRTMIKEANFWGANFVMSGSDCGHIFIWDRDTGEHLMLLEADNKGKLLEHIRCEPILASSGIDYDMRDLVTIRRVRIFNRKLLTEYNSKESMLEKLDTPSGPGSLLLTMLVHLSIS

SEQ ID NO: 756061 - protein, 71 aa, Homo sapiens
MVGGGKRPAKGKNREKIFKFSLLKGFYLHNNATFLPARPNRKSNGCISESSILSGRNMVMRFKKIFLKELN

SEQ ID NO: 756062 - protein, 422 aa, Homo sapiens
MDVLSPGQGNNTTSPPAPFETGGNTTGISDVTVSYQVITSLLLGTLIFCAVLGNACVVAAIALERSLQNVANYLIGSLAVTDLMVSVLVLPMAALYQVLNKWTLGQVTCDLFIALDVLCCTSSILHLCAIALDRYWAITDPIDYVNKRTPRRAAALISLTWLIGFLISIPPMLGWRTPEDRSDPDACTISKDHGYTIYSTFGAFYIPLLLMLVLYGRIFRAARFRIRKTVKKVEKTGADTRHGASPAPQPKKSVNGESGSRNWRLGVESKAGGALCANGAVRQGDDGAALEVIEVHRVGNSKEHLPLPSEAGPTPCAPASFERKNERNAEAKRKMALARERKTVKTLGIIMGTFILCWLPFFIVALVLPFCESSCHMPTLLGAIINWLGYSNSLLNPVIYAYFNKDFQNAFKKIIKCKFCRQ

SEQ ID NO: 756063 - protein, 118 aa, Homo sapiens
PLGCSAAYCLRKFRWATSPLGAPFFTLKLDNSLPSQGSIESEMRLGAVAHTCNFSTLGGRGGWITRSGVRDQPVQYGETLSLLENTKISRAWWHTPVVPATWEAEAGESLEPGRWRLQ

SEQ ID NO: 756064 - protein, 145 aa, Homo sapiens
ADAASASLTPDFLSPGSSNVSSPLPCFGSSFHSTTSFVISDITEETEVEVPELPSVPLLCSASPECCKPEHKAACSSSEEDDCVSLSKASSFADMMGILKDFHRMKQSQDLNRSLLKEEDPAVLISEVLRRKFALKEEDISRKGN

SEQ ID NO: 756065 - protein, 471 aa, Homo sapiens
EVGEEGPAGVEGLNFPAQSRRLPGPQQCSPGAEQGASARARRPRPRPRPAAMVPGVPGAVLTLCLWLAASSGCLAAGPGAAAARRLDESLSAGSVQRAPCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRPSRWYQFRVAAVNVHGTRGFTAPSKHFRSSKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNNRTTGNSGSRNDQHGVGE

SEQ ID NO: 756066 - protein, 105 aa, Homo sapiens
LTVPNLRPSTLYRLEVQVLTPGGEGPATIKTFRTPELPPSSAHSEWGARALSHPVRSCGHREKSCWKMKTNKYTSTGFYEIGKLSSSEILSPCLYRLTRFYSRHL

SEQ ID NO: 756067 - protein, 731 aa, Homo sapiens
EVGEEGPAGVEGLNFPAQSRRLPGPQQCSPGAEQGASARARRPRPRPRPAAMVPGVPGAVLTLCLWLAASSGCLAAGPGAAAARRLDESLSAGSVQRAPCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRPSRWYQFRVAAVNVHGTRGFTAPSKHFRSSKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNKEQLVKTRKGGIQTQLPFQRRRPTRPLEVGAPFYQDGQLQVKVYWKKTEDPTVNRYHVRWFPEACAHNRTTGSEASSGMTHENYIILQDLSFSCKYKVTVQPIRPKSHSKAEAVFFTTPPCSALKGKSHKPIGCLGEAGHVLSKVLAKPENLSASFIVQDVNITGHFSWKMAKANLYQPMTGFQVTWAEVTTESRQNSLPNSIISQSQILPSDHYVLTVPNLRPSTLYRLEVQVLTPGGEGPATIKTFRTPELPPSSAHRSHLKHRHPHHYKPSPERY

SEQ ID NO: 756068 - protein, 684 aa, Homo sapiens
EVGEEGPAGVEGLNFPAQSRRLPGPQQCSPGAEQGASARARRPRPRPRPAAMVPGVPGAVLTLCLWLAASSGCLAAGPGAAAARRLDESLSAGSVQRAPCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRPSRWYQFRVAAVNVHGTRGFTAPSKHFRSSKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNKEQLVKTRKGGIQTQLPFQRRRPTRPLEVGAPFYQDGQLQVKVYWKKTEDPTVNRYHVRWFPEACAHNRTTGSEASSGMTHENYIILQDLSFSCKYKVTVQPIRPKSHSKAEAVFFTTPPCSALKGKSHKPIGCLGEAGHVLSKVLAKPENLSASFIVQDVNITGHFSWKMAKANLYQPMTGFQVTWAEVTTESRQNSLPNSIISQSQILPSVGPTSCTMSVSLVSTAPFY

SEQ ID NO: 756069 - protein, 71 aa, Homo sapiens
MEHIHGEEQKLYPIERLLFLPGDKDTCIGGQKREETKPLQMADVNLVERATGDERKRRRQVMQSVNGAVGW

SEQ ID NO: 756070 - protein, 364 aa, Homo sapiens
GSDLDSLLRCCRFGPARSQPPAARPAQLPPRPLAAVPLLVPSRLVRGCAGGRAGAQGKLEGRAREGSFVDFTAANIWAQRGPPLAVSPPRRLGDPEGAQPQGRRLRFGTSPPGCGSGRCAEAAKQLQPPPRRSTLAPCAMVTHSKFPAAGMSRPLDTSLRLKTFSSKSEYQLVVNAVRKLQESGFYWSAVTGGEANLLLSAEPAGTFLIRDSSDQRHFFTLSVKTQSGTKNLRIQCEGGSFSLQSDPRSTQPVPRFDCVLKLVHHYMPPPGAPSFPSPPTEPSSEVPEQPSAQPLPGSPPRRAYYIYSGGEKIPLVLSRPLSSNVATLQHLCRKTVNGHLDSYEKVTQLPGPIREFLDQYDAPL

SEQ ID NO: 756071 - protein, 364 aa, Homo sapiens; identical to SEQ ID NO: 756070

SEQ ID NO: 756072 - protein, 225 aa, Homo sapiens
MVTHSKFPAAGMSRPLDTSLRLKTFSSKSEYQLVVNAVRKLQESGFYWSAVTGGEANLLLSAEPAGTFLIRDSSDQRHFFTLSVKTQSGTKNLRIQCEGGSFSLQSDPRSTQPVPRFDCVLKLVHHYMPPPGAPSFPSPPTEPSSEVPEQPSAQPLPGSPPRRAYYIYSGGEKIPLVLSRPLSSNVATLQHLCRKTVNGHLDSYEKVTQLPGPIREFLDQYDAPL

SEQ ID NO: 756073 - protein, 215 aa, Homo sapiens
MVTHSKFPAAGMSRPLDTSLRLKTFSSKSEYQLVVNAVRKLQESGFYWSAVTGGEANLLLSAEPAGTFLIRDSSDQRHFFTLSVKTQSGTKNLRIQCEGGSFSLQSDPRSTQPVPRFDCVLKLVHHYTPPTEPSSEVPEQPSAQPLPGSPPRRAYYIYSGGEKIPLVLSRPLSSNVATLQHLCRKTVNGHLDSYEKVTQLPGPIREFLDQYDAPL

SEQ ID NO: 756074 - protein, 364 aa, Homo sapiens; identical to SEQ ID NO: 756070

SEQ ID NO: 756075 - protein, 364 aa, Homo sapiens; identical to SEQ ID NO: 756070

SEQ ID NO: 756076 - protein, 173 aa, Homo sapiens
LLGVWTSVAVVWFDLVDYEEVLGKLGIYDADGDGDFDVDDAKVLLGLKERSTSEPAVPPEEAEPLTEAEKSTKTRKETQKLREFEEGLVSQYKFYLENLEQMVKDWKQRKLKKSNVVSLKAYKGLAEVAVKSLCELLVALPHFNFHNNIIVLIVPLMNDMSKLVSCCKWLLLS

SEQ ID NO: 756077 - protein, 687 aa, Homo sapiens
FPCSEPVHAKKRKHERIIDKYEKIPRTLQTAPEKELIHLLPIKDKSGIIPQTREKPVTDSNKDEEDQEEERELEEEIIEDPIQELTIEEHLIERKKKLQEKKMHIAALASAILSDPENNIKKLKELRSMLMEQDPDVAVTVRKLVIVSLMELFKDITPSYKIRPLTEAEKSTKTRKETQKLREFEEGLVSQYKFYLENLEQMVKDWKQRKLKKSNVVSLKAYKGLAEVAVKSLCELLVALPHFNFHNNIIVLIVPLMNDMSKLISEMCCEAVKKLFKQDKLGQASLGVIKVISGFVKGRNYEVRPEMLKTFLCLRIKEVEVKKDTEDINKPKKFMTFKEKRKSLSRMQRKWKKAEEKLARELREAEASESTEKKLKLHTETLNIVFVTYFRILKKAQRSPLLPAVLEGLAKFAHLINVEFFDDLLVVLHTLIESGDLSYQESLHCVQTAFHILSGQGDVLNIDPLKFYTHLYKTLFKLHAGATNEGVEIVLQCLDVMLTKRRKQVSQQRALAFIKRLCTLALHVLPNSSIGILATTRILMHTFPKTDLLLDSESQGSGVFLPELDEPEYCNAQNTALWELHALRRHYHPIVQRFAAHLIAGAPSEGSGALKPELSRRSATELFEAYSMAEMTFNPPVESSNPKIKGKFLQGDSFLNEDLNQLIKRYSSEVATESPLDFTKYLKTSLH

SEQ ID NO: 756078 - protein, 687 aa, Homo sapiens; identical to SEQ ID NO: 756077

SEQ ID NO: 756079 - protein, 174 aa, Homo sapiens [sequence omitted]

SEQ ID NO: 756080 - protein, 625 aa, Homo sapiens
FPCSEPVHAKKRKHERIIDKYEKIPRTLQTAPEKELIHLLPIKDKSGIIPQTREKPVTDSNKDEEDQEEERELEEEIIEDPIQELTIEEHLIERKKKLQEKKMHIAALASAILSDPENNIKKLKELRSMLMEQDPDVAVTVRKLVIVSLMELFKDITPSYKIRPLTEAEKSTKTRKETQKLREFEEGLVSQYKFYLENLEQMVKDWKQRKLKKSNVVSLKAYKGLAEVAVKSLCELLVALPHFNFHNNIIVLIVPLMNDMSKLISEMCCEAVKKLFKQDKLGQASLGVIKVISGFVKGRNYEVRPEMLKTFLCLRIKEVEVKKDTEDINKPKKFMTFKEKRKSLSRMQRKWKKAEEKLARELREAEASESTEKKLKLHTETLNIVFVTYFRILKKAQRSPLLPAVLEGLAKFAHLINVEFFDDLLVVLHTLIESGDLSYQESLHCVQTAFHILSGQGDVLNIDPLKFYTHLYKTLFKLHAGATNEGVEIVLQCLDVMLTKRRKQVSQQRALAFIKRLCTLALHVLPNSSIGILATTRILMHTFPKTDLLLDSESQGSGVFLPELDEPEYCNAQNTALWELHALRVRVALVFFFLGMFVNNCFPVFLQIVVIARVLNYILFWGCLF

SEQ ID NO: 756081 - protein, 104 aa, Homo sapiens [sequence omitted]

SEQ ID NO: 756082 - protein, 104 aa, Homo sapiens [sequence omitted]

SEQ ID NO: 756083 - protein, 227 aa, Homo sapiens
MAAQLLEEKLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKREAQLRASLEVTQQQATQAEGQLLELRKQSSQIQVRGLCLPAHHGLTLHPGAATSWSLEHQAAGSGAEQGAGHRGPGEVPGTLPPHIPDPQ

SEQ ID NO: 756084 - protein, 485 aa, Homo sapiens
MAAQLLEEKLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKRENSACILASWVSGKFSSLLQALEIQHTTALRSIEVAKTQALAQARDEEQRLRVHLEAVARHGCRIRELLEQVDEQTFLQESQLLQPPGPLGPLTPLQWDEDQQLGDLKQLLSRLCGLLLEEGSHPGAPAKPVDLAPVEAPGPLAPVPSTVCPLRRKLWQNYRNLTFDPVSANRHFYLSRQDQQVKHCRQSRGPGGPGSFELWQVQCAQSFQAGHHYWEVRASDHSVTLGVSYPQLPRCRLGPHTDNIGRGPCSWGLCVQEDSLQAWHNGEAQRLPGVSGRLLGMDLDLASGCLTFYSLEPQTQPLYTFHALFNQPLTPVFWLLEGRTLTLCHQPGAVFPLGPQEEVLS

SEQ ID NO: 756085 - protein, 495 aa, Homo sapiens
MAAQLLEEKLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKREAQLRASLEVTQQQATQAEGQLLELRKQSSQIQNSACILASWVSGKFSSLLQALEIQHTTALRSIEVAKTQALAQARDEEQRLRVHLEAVARHGCRIRELLEQVDEQTFLQESQLLQPPGPLGPLTPLQWDEDQQLGDLKQLLSRLCGLLLEEGSHPGAPAKPVDLAPVDYRNLTFDPVSANRHFYLSRQDQQVKHCRQSRGPGGPGSFELWQVQCAQSFQAGHHYWEVRASDHSVTLGVSYPQLPRCRLGPHTDNIGRGPCSWGLCVQEDSLQAWHNGEAQRLPGVSGRLLGMDLDLASGCLTFYSLEPQTQPLYTFHALFNQPLTPVFWLLEGRTLTLCHQPGAVFPLGPQEEVLS

SEQ ID NO: 756086 - protein, 517 aa, Homo sapiens
MAAQLLEEKLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKREAQLRASLEVTQQQATQAEGQLLELRKQSSQIQNSACILASWVSGKFSSLLQALEIQHTTALRSIEVAKTQALAQARDEEQRLRVHLEAVARHGCRIRELLEQVDEQTFLQESQLLQPPGPLGPLTPLQWDEDQQLGDLKQLLSRLCGLLLEEGSHPGAPAKPVDLAPVEAPGPLAPVPSTVCPLRRKLWQNYRNLTFDPVSANRHFYLSRQDQQVKHCRQSRGPGGPGSFELWQVQCAQSFQAGHHYWEVRASDHSVTLGVSYPQLPRCRLGPHTDNIGRGPCSWGLCVQEDSLQAWHNGEAQRLPGVSGRLLGMDLDLASGCLTFYSLEPQTQPLYTFHALFNQPLTPVFWLLEGRTLTLCHQPGAVFPLGPQEEVLS

SEQ ID NO: 756087 - protein, 350 aa, Homo sapiens
MAAQLLEEKLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKREAQLRASLEVTQQQATQAEGQLLELRKQSSQIQNSACILASWVSGKFSSLLQALEIQHTTALRSIEVAKTQALAQARDEEQRLRVHLEAVARHGCRIRELLEQVDEQTFLQESQLLQPPGPLGPLTPLQWDEDQQLGDLKQLLSRLCGLLLEEGSHPGAPAKPVDLAPVDYRNLTFDPVSANRHFYLSRQDQQVESCSLKKTYSDPNPQDLWL

SEQ ID NO: 756088 - protein, 385 aa, Homo sapiens
MAAQLLEEKLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKREAQLRASLEVTQQQATQAEGQLLELRKQSSQIQNSACILASWVSGKFSSLLQALEIQHTTALRSIEVAKTQALAQARDEEQRLRVHLEAVARHGCRIRELLEQVDEQTFLQESQLLQPPGPLGPLTPLQWDEDQQLGDLKQLLSRLCGLLLEEGSHPGAPAKPVDLAPVDYRNLTFDPVSANRHFYLSRQDQQVKHCRQSRGPGGPGSFELWQVQCAQSFQAGHHYWEVESCSLKKTYSDPNPQDLWL

SEQ ID NO: 756089 - protein, 517 aa, Homo sapiens; identical to SEQ ID NO: 756086

SEQ ID NO: 756090 - protein, 517 aa, Homo sapiens; identical to SEQ ID NO: 756086

SEQ ID NO: 756091 - protein, 517 aa, Homo sapiens; identical to SEQ ID NO: 756086

SEQ ID NO: 756092 - protein, 352 aa, Homo sapiens
MAGTICFIMWVLFITDTVWSRSVRQVYEVHDSDDWTIHDFECPMECFCPPSFPTALYCENRGLKEIPAIPSRIWYLYLQNNLIETIPEKPFENATQLRWINLNKNKITNYGIEKGALSQLKKLLFLFLEDNELEEVPSPLPRSLEQLQLARNKVSRIPQGTFSNLENLTLLDLQNNKLVDNAFQRDTFKGLKNLMQLNMAKNALRNMPPRLPANTMQLFLDNNSIEGIPENYFNVIPKVAFLRLNHNKLSDEGLPSRGFDVSSILDLQLSHNQLTKVPRISAHLQHLHLDHNKIKSVNVSVICPSPSMLPAERDSFSYGPHLRYLRLDGNEIKPPIPMALMTCFRLLQAVII

SEQ ID NO: 756093 - protein, 121 aa, Homo sapiens
ILRVAVTDEVTYFVLFLGKLLVAGSIGVLAFLFFTQRLPVIAQGPASLNYYWVPLLTVIFGSYLIAHGFFSVYAMCVETIFICFCEDLERNDGSTEKPYFVTPNLHGILIKKQLVPQKQKE

SEQ ID NO: 756094 - protein, 119 aa, Homo sapiens
ILRVAVTDEVTYFVLFLGKLLVAGSIGVLAFLFFTQRLPVIAQGPASLNYYWVPLLTVIFGSYLIAHGFFSVYAMCVETIFICFLEDLERNDGSTARPYYVSQPLLKIFQEENPQTRKQ

SEQ ID NO: 756095 - protein, 101 aa, Homo sapiens
SGTISAHYNLQLPGSSNSHASASGVAGTTGTCHHARLIFVFLVEMGFRDLSSLQPPPPRFKQFSCLSLPSSPPPCPANFYIISRDGVLPCWPGWYRTPDLR

SEQ ID NO: 756096 - protein, 1437 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLLEGSIAISGTFAYVAQQAWILNATLRDNILFGKEYDEERYNSVLNSCCLRPDLAILPSSDLTEIGERGANLSGGQRQRISLARALYSDRSIYILDDPLSALDAHVGNHIFNSAIRKHLKSKTVLFVTHQLQYLVDCDEVIFMKEGCITERGTHEELMNLNGDYATIFNNLLLGETPPVEINSKKETSGSQKKSQDKGPKTGSVKKEKAVKPEEGQLVQLEEKGQGSVPWSVYGVYIQAAGGPLAFLVIMALFMLNVGSTAFSTWWLSYWIKQGSGNTTVTRGNETSVSDSMKDNPHMQYYASIYALSMAVMLILKAIRGVVFVKGTLRASSRLHDELFRRILRSPMKFFDTTPTGRILNRFSKDMDEVDVRLPFQAEMFIQNVILVFFCVGMIAGVFPWFLVAVGPLVILFSVLHIVSRVLIRELKRLDNITQSPFLSHITSSIQGLATIHAYNKGQEFLHRYQELLDDNQAPFFLFTCAMRWLAVRLDLISIALITTTGLMIVLMHGQIPPAYAGLAISYAVQLTGLFQFTVRLASETEARFTSVERINHYIKTLSLEAPARIKNKAPSPDWPQEGEVTFENAEMRYRENLPLVLKKVSFTIKPKEKIGIVGRTGSGKSSLGMALFRLVELSGGCIKIDGVRISDIGLADLRSKLSIIPQEPVLFSGTVRSNLDPFNQYTEDQIWDALERTHMKECIAQLPLKLESEVMENGDNFSVGERQLLCIARALLRHCKILILDEATAAMDTETDLLIQETIREAFADCTMLTIAHRLHTVLGSDRIMVLAQGQVVEFDTPSVLLSNDSSRFYAMFAAAENKVAVKG

SEQ ID NO: 756097 - protein, 1276 aa, Homo sapiens
MVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKLPSTVQPDVFCYVSVRPRLVSLVLIQCLIFAPPHNSYQSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLLEGSIAISGTFAYVAQQAWILNATLRDNILFGKEYDEERYNSVLNSCCLRPDLAILPSSDLTEIGERGANLSGGQRQRISLARALYSDRSIYILDDPLSALDAHVGNHIFNSAIRKHLKSKTVLFVTHQLQYLVDCDEVIFMKEGCITERGTHEELMNLNGDYATIFNNLLLGETPPVEINSKKETSGSQKKSQDKGPKTGSVKKEKAVKPEEGQLVQLEEKGQGSVPWSVYGVYIQAAGGPLAFLVIMALFMLNVGSTAFSTWWLSYWIKQGSGNTTVTRGNETSVSDSMKDNPHMQYYASIYALSMAVMLILKAIRGVVFVKGTLRASSRLHDELFRRILRSPMKFFDTTPTGRILNRFSKDMDEVDVRLPFQAEMFIQNVILVFFCVGMIAGVFPWFLVAVGPLVILFSVLHIVSRVLIRELKRLDNITQSPFLSHITSSIQGLATIHAYNKGQEFLHRYQELLDDNQAPFFLFTCAMRWLAVRLDLISIALITTTGLMIVLMHGQIPPAYAGLAISYAVQLTGLFQFTVRLASETEARFTSVERINHYIKTLSLEAPARIKNKAPSPDWPQEGEVTFENAEMRYRENLPLVLKKVSFTIKPKEKIGIVGRTGSGKSSLGMALFRLVELSGGCIKIDGVRISDIGLADLRSKLSIIPQEPVLFSGTVRSNLDPFNQYTEDQIWDALERTHMKECIAQLPLKLESEVMENGDNFSVGERQLLCIARALLRHCKILILDEATAAMDTETDLLIQETIREAFADCTMLTIAHRLHTVLGSDRIMVLAQGQVVEFDTPSVLLSNDSSRFYAMFAAAENKVAVKG

SEQ ID NO: 756098 - protein, 1437 aa, Homo sapiens; identical to SEQ ID NO: 756096

SEQ ID NO: 756099 - protein, 208 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPNFQDGCILRSE

SEQ ID NO: 756100 - protein, 1437 aa, Homo sapiens; identical to SEQ ID NO: 756096

SEQ ID NO: 756101 - protein, 222 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPFSLPLETAPSVPRCVGTGFTAPPSY

SEQ ID NO: 756102 - protein, 240 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPPTDLRKEGMNLQTLRLRSSNKHQRFPGLPRAPVYQKLLERMKH

SEQ ID NO: 756103 - protein, 211 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPPFMVKHLLEYTQTR

SEQ ID NO: 756104 - protein, 1475 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKLPSTVQPDVFCYVSVRPRLVSLVLIQCLIFAPLYNSYQSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLLEGSIAISGTFAYVAQQAWILNATLRDNILFGKEYDEERYNSVLNSCCLRPDLAILPSSDLTEIGERGANLSGGQRQRISLARALYSDRSIYILDDPLSALDAHVGNHIFNSAIRKHLKSKTVLFVTHQLQYLVDCDEVIFMKEGCITERGTHEELMNLNGDYATIFNNLLLGETPPVEINSKKETSGSQKKSQDKGPKTGSVKKEKAVKPEEGQLVQLEEKGQGSVPWSVYGVYIQAAGGPLAFLVIMALFMLNVGSTAFSTWWLSYWIKQGSGNTTVTRGNETSVSDSMKDNPHMQYYASIYALSMAVMLILKAIRGVVFVKGTLRASSRLHDELFRRILRSPMKFFDTTPTGRILNRFSKDMDEVDVRLPFQAEMFIQNVILVFFCVGMIAGVFPWFLVAVGPLVILFSVLHIVSRVLIRELKRLDNITQSPFLSHITSSIQGLATIHAYNKGQEFLHRYQELLDDNQAPFFLFTCAMRWLAVRLDLISIALITTTGLMIVLMHGQIPPAYAGLAISYAVQLTGLFQFTVRLASETEARFTSVERINHYIKTLSLEAPARIKNKAPSPDWPQEGEVTFENAEMRYRENLPLVLKKVSFTIKPKEKIGIVGRTGSGKSSLGMALFRLVELSGGCIKIDGVRISDIGLADLRSKLSIIPQEPVLFSGTVRSNLDPFNQYTEDQIWDALERTHMKECIAQLPLKLESEVMENGDNFSVGERQLLCIARALLRHCKILILDEATAAMDTETDLLIQETIREAFADCTMLTIAHRLHTVLGSDRIMVLAQGQVVEFDTPSVLLSNDSSRFYAMFAAAENKVAVKG

SEQ ID NO: 756105 - protein, 506 aa, Homo sapiens
TLCSAPQGTLRASSRLHDELFRRILRSPMKFFDTTPTGRILNRFSKDMDEVDVRLPFQAEMFIQNVILVFFCVGMIAGVFPWFLVAVGPLVILFSVLHIVSRVLIRELKRLDNITQSPFLSHITSSIQGLATIHAYNKGQEFLHRYQELLDDNQAPFFLFTCAMRWLAVRLDLISIALITTTGLMIVLMHGQIPPAYAGLAISYAVQLTGLFQFTVRLASETEARFTSVERINHYIKTLSLEAPARIKNKAPSPDWPQEGEVTFENAEMRYRENLPLVLKKVSFTIKPKEKIGIVGRTGSGKSSLGMALFRLVELSGGCIKIDGVRISDIGLADLRSKLSIIPQEPVLFSGTVRSNLDPFNQYTEDQIWDALERTHMKECIAQLPLKLESEVMENGDNFSVGERQLLCIARALLRHCKILILDEATAAMDTETDLLIQETIREAFADCTMLTIAHRLHTVLGSDRIMVLAQGQVVEFDTPSVLLSNDSSRFYAMFAAAENKVAVKG

SEQ ID NO: 756106 - protein, 1437 aa, Homo sapiens; identical to SEQ ID NO: 756096

SEQ ID NO: 756107 - protein, 208 aa, Homo sapiens; identical to SEQ ID NO: 756099

SEQ ID NO: 756108 - protein, 231 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPVSSNHPFRQSPGARPRPALTLLFCCRGCAQLWAR

SEQ ID NO: 756109 - protein, 636 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLRGQPLRGQRCPLKVTRKEAEVE

SEQ ID NO: 756110 - protein, 781 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 756111 - protein, 781 aa, Homo sapiens; identical to SEQ ID NO: 756110

SEQ ID NO: 756112 - protein, 774 aa, Homo sapiens
MELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 756113 - protein, 781 aa, Homo sapiens; identical to SEQ ID NO: 756110

SEQ ID NO: 756114 - protein, 141 aa, Homo sapiens
MRGRGARMAPHAFLGCLGGCSSHLRGPSEDTRRHQPHEIWDVHGTSMKPSEMIWSSLQRLTKFRESGKGKLRKSPQDRVEHVARSAAAWTSPIVLAVLLWPRWGRRPDVLTSPNPSPVVHVVHCTRALAEDQVGVEIQPWH

SEQ ID NO: 756115 - protein, 105 aa, Homo sapiens
KFHLLKGPEIPPPKQPYSLGKTPPFTVITSCPHSRIISVPSKQGESCLKSCLTNCIFIGDGHSCIAPQGGDTNCIPLWLMMPSVRSFLQVRYQCKVGKSSAAIDN

SEQ ID NO: 756116 - protein, 866 aa, Homo sapiens
MLRPGAQLLRGLLLRSCPLQGSPGRPRSVCGREGEEKPPLSAETQWKDRAETVIIGGGCVGVSLAYHLAKAGMKDVVLLEKSELTAGSTWHAAGLTTYFHPGINLKKIHYDSIKLYEKLEEETGQVVGFHQPGSIRLATTPVRVDEFKYQMTRTGWHATEQYLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKPADFIGKQALKQIKAKGLKRRLVCLTLATDDVDPEGNESIWYNGKVVGNTTSGSYSYSIQKSLAFAYVPVQLSEVGQQVEVELLGKNYPAVIIQEPLVLTEPTRNRLQKKGGKDKT

SEQ ID NO: 756117 - protein, 848 aa, Homo sapiens
MLRPGAQLLRGLLLRSCPLQGSPGRPRSVCGREGEEKPPLSAETQWKDRAETVIIGGGCVGVSLAYHLAKAGMKDVVLLEKSELTAGSTWHAAGLTTYFHPGINLKKIHYDSIKLYEKLEEETGQVVGFHQPGSIRLATTPVRVDEFKYQMTRTGWHATEQYLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKPADFIGKQALKQIKAKGLKRRLVCLTLATDDVDPEGNESIWYNGKVVGNTTSGSYSYSIQKSLAFAYVPVQLSEVGQQVEVELLGKNYPAVIIQEPLVLTEPTRNRLQKKGGKDKT

SEQ ID NO: 756118 - protein, 111 aa, Homo sapiens
SYWRPWTANFDFEGEGQRQRNRERYDRDSIFAEEITRAQGATPSPTLHFGKGRYRFCGFSQKMCFHQKRAHFSFLLIANFPSIFCESHTPELHSISPVYFSGFPSWVGEIA

SEQ ID NO: 756119 - protein, 130 aa, Homo sapiens
MMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 756120 - protein, 339 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 756121 - protein, 312 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTSFSSFHRVDSIVWI

SEQ ID NO: 756122 - protein, 215 aa, Homo sapiens
MFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 756123 - protein, 215 aa, Homo sapiens; identical to SEQ ID NO: 756122

SEQ ID NO: 756124 - protein, 182 aa, Homo sapiens [sequence omitted]

SEQ ID NO: 756125 - protein, 109 aa, Homo sapiens
GLTLELPGERKQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 756126 - protein, 339 aa, Homo sapiens; identical to SEQ ID NO: 756120

SEQ ID NO: 756127 - protein, 339 aa, Homo sapiens; identical to SEQ ID NO: 756120

SEQ ID NO: 756128 - protein, 280 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEIVSEERKRGNQNLQNLRLSLSS

SEQ ID NO: 756129 - protein, 151 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQVWSLWQ

SEQ ID NO: 756130 - protein, 223 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAESPQCQCFLSFPTTKTYFPHFDLSHGSAQGKGHGKKVADALTNAVGTW

SEQ ID NO: 756131 - protein, 151 aa, Homo sapiens; identical to SEQ ID NO: 756129

SEQ ID NO: 756132 - protein, 161 aa, Homo sapiens
HTPAPTGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNIL

SEQ ID NO: 756133 - protein, 297 aa, Homo sapiens
ESAGSRRGAQRVLASGRAVQGAGWHAGPKLSSASGPNNSFTKGAAFYPGHTEVHSVMSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 756134 - protein, 173 aa, Homo sapiens
QEQVVLSPTHTLTLSHTENSPLWKMGWDDDRLLLLSPVEGGSTTDLEVQILSVCSFTGRLGAKQHTVVNGVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 756135 - protein, 107 aa, Homo sapiens [sequence omitted]

SEQ ID NO: 756136 - protein, 1315 aa, Homo sapiens
VRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 756137 - protein, 1346 aa, Homo sapiens
VRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 756138 - protein, 882 aa, Homo sapiens
METVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 756139 - protein, 425 aa, Homo sapiens
SRSIPEAWGRRDDPPGLSRALLSSCCPLARTRRTPRLVFTPSSPYPHTPKTEQTPIPGLEDPPLGSQLRRRPGEGETDIPSRAVPPLPPLPTLCSFPAPEVQGPPASCAPAAGTLDLLRAAGCRPGKMARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 756140 - protein, 425 aa, Homo sapiens; identical to SEQ ID NO: 756139

SEQ ID NO: 756141 - protein, 222 aa, Homo sapiens
GLPLHLCCGDSTDVRGVPWATLGLRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 756142 - protein, 401 aa, Homo sapiens
SRSIPEAWGRRDDPPGLSRALLSSCCPLARTRRTPRLVFTPSSPYPHTPKTEQTPIPGLEDPPLGSQLRRRPGEGETDIPSRAVPPLPPLPTLCSFPAPEVQGPPASCAPAAGTLDLLRAAGCRPGKMARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQ

SEQ ID NO: 756143 - protein, 210 aa, Homo sapiens
MIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 756144 - protein, 397 aa, Homo sapiens
SRSIPEAWGRRDDPPGLSRALLSSCCPLARTRRTPRLVFTPSSPYPHTPKTEQTPIPGLEDPPLGSQLRRRPGEGETDIPSRAVPPLPPLPTLCSFPAPEVQGPPASCAPAAGTLDLLRAAGCRPGKMARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVCGLGVCYAQRKGYFSRRVILHLKPRQ

SEQ ID NO: 756145 - protein, 265 aa, Homo sapiens
SRSIPEAWGRRDDPPGLSRALLSSCCPLARTRRTPRLVFTPSSPYPHTPKTEQTPIPGLEDPPLGSQLRRRPGEGETDIPSRAVPPLPPLPTLCSFPAPEVQGPPASCAPAAGTLDLLRAAGCRPGKMARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLGDVHVCV

SEQ ID NO: 756146 - protein, 104 aa, Homo sapiens
ELSPFSDSASHRQSLVGAMMTDTSCHTHRHTHGIHTAVHTCKQQCTCTQARAHNFKLTCGYTTQSIHIEVHMHSTHTHSTLMPTGVHVHTHTHSPAISLHPSRT

SEQ ID NO: 756147 - protein, 408 aa, Homo sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 756148 - protein, 435 aa, Homo sapiens
EALLGSNCRAIQLLTNSCRTSVTVEGNEANILRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 756149 - protein, 408 aa, Homo sapiens; identical to SEQ ID NO: 756147

SEQ ID NO: 756150 - protein, 408 aa, Homo sapiens; identical to SEQ ID NO: 756147

SEQ ID NO: 756151 - protein, 444 aa, Homo sapiens
VSLYSNIPFRSHSVVPSRATHCCSFPEPFQQVCSRLAVKNHGLLLYALFSVILLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 756152 - protein, 460 aa, Homo sapiens
TRGSTHASGRGGGREGRSAEPGPEARSHSVVPSRATHCCSFPEPFQQVCSRLAVKNHGLLLYALFSVILLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 756153 - protein, 461 aa, Homo sapiens
MSVSALSRVNRNCGGDFLCEPITHAKLVARLAVYTNHRHVYMYMPVYSVMTDTMIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 756154 - protein, 408 aa, Homo sapiens; identical to SEQ ID NO: 756147

SEQ ID NO: 756155 - protein, 408 aa, Homo sapiens; identical to SEQ ID NO: 756147

SEQ ID NO: 756156 - protein, 408 aa, Homo sapiens; identical to SEQ ID NO: 756147

SEQ ID NO: 756157 - protein, 383 aa, Homo sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHHASSGLTSHASSGLTSMQGRANQPCKVGTNQPCKV

SEQ ID NO: 756158 - protein, 1514 aa, Homo sapiens
RRWDPRRQKAPMAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTTRILVTHALHILPQADWIIVLANGAIAEMGSYQELLQRKGALVCLLDQARQPGDRGEGETEPGTSTKDPRGTSAGRRPELRRERSIKSVPEKDRTTSEAQTEVPLDDPDRAGWPAGKDSIQYGRVKATVHLAYLRAVGTPLCLYALFLFLCQQVASFCRGYWLSLWADDPAVGGQQTQAALRGGIFGLLGCLQAIGLFASMAAVLLGGARASRLLFQRLLWDVVRSPISFFERTPIGHLLNRFSKETDTVDVDIPDKLRSLLMYAFGLLEVSLVVAVATPLATVAILPLFLLYAGFQSLYVVSSCQLRRLESASYSSVCSHMAETFQGSTVVRAFRTQAPFVAQNNARVDESQRISFPRLVADRWLAANVELLGNGLVFAAATCAVLSKAHLSAGLVGFSVSAALQVTQTLQWVVRNWTDLENSIVSVERMQDYAWTPKEAPWRLPTCAAQPPWPQGGQIEFRDFGLRYRPELPLAVQGVSFKIHAGEKVGIVGRTGAGKSSLASGLLRLQEAAEGGIWIDGVPIAHVGLHTLRSRISIIPQDPILFPGSLRMNLDLLQEHSDEAIWAALETVQLKALVASLPGQLQYKCADRGEDLSVGQKQLLCLARALLRKTQILILDEATAAVDPGTELQMQAMLGSWFAQCTVLLIAHRLRSVMDCARVLVMDKGQVAESGSPAQLLAQKGLFYRLAQESGLV

SEQ ID NO: 756159 - protein, 416 aa, Homo sapiens
RRWDPRRQKAPMAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKASTAYLKKYSEVN

SEQ ID NO: 756160 - protein, 974 aa, Homo sapiens
RRWDPRRQKAPMAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTTRILVTHALHILPQADWIIVLANGAIAEMGSYQELLQRKGALVCLLDQARQPGDRGEGETEPGTSTKDPRGTSAGRRPELRRERSIKSVPEKDRTTSEAQTEVPLDDPDRAGWPAGKDSIQYGRVTTSFTHPSPPTVPPPGAQVLPPNVALGSDTHLS

SEQ ID NO: 756161 - protein, 110 aa, Homo sapiens
RRWDPRRQKAPMAAPAEPCAGQGVWNQTEPEPAATSLLSLCFLRTAGVWVPPMYLWVLGPIYLLFIHHHGRGYLRMSPLFKAKMVAAIPGSLEPGNVRGRQGTGWNLVKS

SEQ ID NO: 756162 - protein, 491 aa, Homo sapiens
SASAAAGPITRRPVPAAARASNRARSPAARCPPPPGTGMALRGFCSRWLRPALAIGLFASMAAVLLGGARASRLLFQRLLWDVVRSPISFFERTPIGHLLNRFSKETDTVDVDIPDKLRSLLMYAFGLLEVSLVVAVATPLATVAILPLFLLYAGFQVACGQCGAPGEWPGVCSCHVCCAEQSPPQCWPRGLLCLCCPPGDPDTAVGCSQLDRPREQHRVSGADAGLCLDAQGGSLEAATCAAQPPWPQGGQIEFRDFGLRYRPELPLAVQGVSFKIHAGEKVGIVGRTGAGKSSLASGLLRLQEAAEGGIWIDGVPIAHVGLHTLRSRISIIPQDPILFPGSLRMNLDLLQEHSDEAIWAALETVQLKALVASLPGQLQYKCADRGEDLSVGQKQLLCLARALLRKTQILILDEATAAVDPGTELQMQAMLGSWFAQCTVLLIAHRLRSVMDCARVLVMDKGQVAESGSPAQLLAQKGLFYRLAQESGLV

SEQ ID NO: 756163 - protein, 349 aa, Homo sapiens
SILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPMGQRGREGPMGPRGEAGPPGSGEKGERGAAGEPGPHGPPGVPGSVGPKGSSGSPGPQGPPGPVGLQGLRGEVGLPGVKGDKGPMGPPGPKGDQGEKGPRGLTGEPGMRGLPGAVGEPGAKGAMGPAGPDGHQGPRGEQGLTGMPGIRGPPGPSGDPGKPGLTGPQGPQGLPGTPGRPGIKGEPGAPGKIVTSEGSSMLTVPGPPGPPGAMGPPGPPGAPGPAGPAGLPGHQEVLNLP

SEQ ID NO: 756164 - protein, 1017 aa, Homo sapiens
SKSRGLRSYTGGRTGASRPRPGRGSGGGNMEQSRSQQRGGEQSWWGSDPQYQYMPFEHCTSYGLPSENGGLQHRLRKDAGPRHNVHPTQIYGHHKEQFSDREQDIGMPKKTGSSSTVDSKDEDHYSKCQDCIHRLGQVVRRKLGEDWIFLVLLGLLMALVSWSMDYVSAKSLQAYKWSYAQMQPSLPLQFLVWVTFPLVLILFSALFCHLISPQAVGSGIPEMKTILRGVVLKEYLTMKAFVAKVVALTAGLGSGIPVGKEGPFVHIASICAAVLSKFMSVFCGVYEQPYYYSDILTVGCAVGVGCCFGTPLGGVLFSIEVTSTYFAVRNYWRGFFAATFSAFVFRVLAVWNKDAVTITALFRTNFRMDFPFDLKELPAFAAIGICCGLLGAVFVYLHRQVMLGVRKHKALSQFLAKHRLLYPGIVTFVIASFTFPPGMGQFMAGELMPREAISTLFDNNTWVKHAGDPESLGQSAVWIHPRVNVVIIIFLFFVMKFWMSIVATTMPIPCGGFMPVFVLGAAFGRLVGEIMAMLFPDGILFDDIIYKILPGGYAVIGAAALTGAVSHTVSTAVICFELTGQIAHILPMMVAVILANMVAQSLQPSLYDSIIQVKKLPYLPDLGWNQLSKYTIFVEDIMVRDVKFVSASYTYGELRTLLQTTTVKTLPLVDSKDSMILLGSVERSELQALLQRHLCPERRLRAAQEMARKLSELPYDGKARLAGEGPPGAPPGRPESFAFVDEDEDEDLSGKSELPPSLALHPSTTAPLSPEEPNGPLPGHKQQPEAPEPAGQRPSIFQSLLHCLLGRARPTKKKTTQDSTDLVDNMSPEEIEAWEQEQLSQPVCFDSCCIDQSPFQLVEQTTLHKTHTLFSLLGLHLAYVTSMGKLRGVLALEELQKAIEGHTKSGVQLRPPLASFRNTTSTRKSTGAPPSSAENWNLPEDRPGATGTGDVIAASPETPVPSPSPEPPLSLAPGKVEGELEELELVESPGLEEELADILQGPSLRSTDEEDEDELIL

SEQ ID NO: 756165 - protein, 1495 aa, Homo sapiens
MANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGPKGPTGSPGTSGPPGSAGPPGSPGPQGSTGPQGNSGLPGDPGFKGEAGPKGEPGPHGIQGPIGPPGEEGKRGPRGDPGTLGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIKGQPGTMGLPGPKGSNGDPGKPGEAGNPGVPGQRGAPGKDGKVGPYGPPGPPGLRGERGEQGPPGPTGFQGHPGPPGPPGEGGKPGDQGVPGGPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGAGGLPGPLGPPGPAGLLGEKGEPGPRGLVGPPGSRGNPGSRGENGPTGAVGFAGPQGSDGQPGVKGEPGEPGQKGDAGSPGPQGLAGSPGPHGPNGVPGLKGGRGTQGPPGATGFPGSAGRVGPPGPAGAPGPAGPLGEPGKEGPPGPRGDPGSHGRVGVRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGHLGRAGKRGLPGPQGPRGDKGDHGDRGDRGQKGHRGFTGLQGLPGPPGPNGEQGSAGIPGPFGPRGPPGPVGPSGKEGNPGPLGPLGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 756166 - protein, 69 aa, Homo sapiens
GRDVTGSVPVTHDLHVLAVVSAQCVLWDRIISKPPKEDPLPNLTPASEGLGGLWHTLPAGFVLERAGGT

SEQ ID NO: 756167 - protein, 363 aa, Homo sapiens
MKRSLSENSARSTAGCLPVPLFNQKKRNRQPLTSNPLKDDSGISTPSDNYDFPPLPTDWAWEAVNPELAPVMKTVDTGQIPHSASRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 756168 - protein, 320 aa, Homo sapiens
MKRSLSENSARSTADWAWEAVNPELAPVMKTVDTGQIPHSASRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 756169 - protein, 363 aa, Homo sapiens; identical to SEQ ID NO: 756167

SEQ ID NO: 756170 - protein, 363 aa, Homo sapiens; identical to SEQ ID NO: 756167

SEQ ID NO: 756171 - protein, 363 aa, Homo sapiens; identical to SEQ ID NO: 756167

SEQ ID NO: 756172 - protein, 1028 aa, Homo sapiens
MKVNRETKRLYVGGLSQDISEADLQNQFSRFGEVSDVEIITRKDDQGNPQKVFAYINISVAEADLKKSIFHVIQRDSSDEENSSMYNSAGLGPFHLASADMEHFTGMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSSDNV

SEQ ID NO: 756173 - protein, 915 aa, Homo sapiens
MVLVFHKGELGHPLEQQHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSSDNV

SEQ ID NO: 756174 - protein, 296 aa, Homo sapiens
MKVNRETKRLYVGGLSQDISEADLQNQFSRFGEVSDVEIITRKDDQGNPQKVFAYINISVAEADLKKCMSVLNKTKWKGGNITNSTSKRKLSDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSSDNV

SEQ ID NO: 756175 - protein, 235 aa, Homo sapiens
MTLIWRHLLRPLCLVTSAPRILEMHPFLSLGTSRTSVTKLSLHTKPRMPPCDFMPERYQSLGYNRVLEIHKEHLSPVVTAYFQKPLLLHQGHMEWLFDAEGNRYLDFFSGIVTVSVGHCHPKVNAVAQKQLGRLWHTSTVFFHPPMHEYAEKLAALLPEPLKVIFLVNSGSEANELAMLMARAHSNNIDIISFRGAYHGCSPYTLGLTNVGTYKMELPGGTGCQPVSLEIFLLFL

SEQ ID NO: 756176 - protein, 514 aa, Homo sapiens
MTLIWRHLLRPLCLVTSAPRILEMHPFLSLGTSRTSVTKLSLHTKPRMPPCDFMPERYQSLGYNRVLEIHKEHLSPVVTAYFQKPLLLHQGHMEWLFDAEGNRYLDFFSGIVTVSVGHCHPKVNAVAQKQLGRLWHTSTVFFHPPMHEYAEKLAALLPEPLKVIFLVNSGSEANELAMLMARAHSNNIDIISFRGAYHGCSPYTLGLTNVGTYKMELPGGTGCQPTMCPDVFRGPWGGSHCRDSPVQTIRKCSCAPDCCQAKDQYIEQFKDTLSTSVAKSIAGFFAEPIQGVNGVVQYPKGFLKEAFELVRARGGVCIADEVQTGFGRLGSHFWGFQTHDVLPDIVTMAKGIGNGFPMAAVITTPEIAKSLAKCLQHFNTFGGNPMACAIGSAVLEVIKEENLQENSQEVGTYMLLKFAKLRDEFEIVGDVRGKGLMIGIEMVQDKISCRPLPREEVNQIHEDCKHMGLLVGRGSIFSQTFRIAPSMCITKPEVDFAVEVFRSALTQHMERRAK

SEQ ID NO: 756177 - protein, 514 aa, Homo sapiens; identical to SEQ ID NO: 756176

SEQ ID NO: 756178 - protein, 434 aa, Homo sapiens
MTLIWRHLLRPLCLVTSAPRILEMHPFLSLGTSRTSVTKLSLHTKPRMPPCDFMPERYQSLGYNRVLEIHKEHLSPVVTAYFQKPLLLHQGHMEWLFDAEGNRYLDFFSGIVTVSVGHCHPKVNAVAQKQLGRLWHTSTVFFHPPMHEYAEKLAALLPEPLKVIFLVNSGSEANELAMLMARAHSNNIDIISFRGAYHGCSPYTLGLTNVGTYKMELPGGTGCQPTMCPDVFRGPWGGSHCRDSPVQTIRKCSCAPDCCQAKDQYIEQFKDTLSTSVAKSIAGFFAEPIQGVNGVVQYPKGFLKEAFELVRARGGVCIADEVQTGFGRLGSHFWGFQTHDVLPDIVTMAKGIGNGFPMAAVITTPEIAKSLAKCLQHFNTFGGNPMACAIGSAVLEVGSSGHINLTHFTNDSFKTTHALAELYHAELLKGRVNS

SEQ ID NO: 756179 - protein, 514 aa, Homo sapiens; identical to SEQ ID NO: 756176

SEQ ID NO: 756180 - protein, 242 aa, Homo sapiens
DPRLRGEGYSRENCGCGQGVNGVVQYPKGFLKEAFELVRARGGVCIADEVQTGFGRLGSHFWGFQTHDVLPDIVTMAKGIGNGFPMAAVITTPEIAKSLAKCLQHFNTFGGNPMACAIGSAVLEVIKEENLQENSQEVGTYMLLKFAKLRDEFEIVGDVRGKGLMIGIEMVQDKISCRPLPREEVNQIHEDCKHMGLLVGRGSIFSQTFRIAPSMCITKPEVDFAVEVFRSALTQHMERRAK

SEQ ID NO: 756181 - protein, 135 aa, Homo sapiens
LLTATSSEVRTMHDTEKMLTDGFNESNIEESMSAGNKQDRWQHSMPLRTWLWIQIPDQSLNFKPLCLSEPLFSHLSSGNNNKWYVPHRGTLRIKREGFNKSSTDFKTWHIVGTQHMALIYLWPAAAGPHPSLAGS

SEQ ID NO: 756182 - protein, 70 aa, Homo sapiens
SPGPLSGSSGRRAFSYPLSAALLLLFKSCFFLLLLLVLFHDLFICRHGQNVLINKFVKKKSGSLLIQTLV

SEQ ID NO: 756183 - protein, 128 aa, Homo sapiens
MQRHHCLTSLCVSDLRQFSRNQFLVLQCHWQLPRASRTLVAWWELLFLTRPLHSPGPVRFLPGYMELDFHFSLVNGDADYLEALAPKFEIPLSEWFWRSPSFSYTIGFLSCSFRLPNLLYNPHPPSKE

SEQ ID NO: 756184 - protein, 110 aa, Homo sapiens
MQRHHCLTSLCVSDLRQFSRNQFLVLQCHWQLPRASRTLVAWWELLFLTRPLHSPGPVRFLPGYMELDFHFSLVHRGQEPGWNGCQGDCLFSEPLTGSQQDRTPLLLGEW

SEQ ID NO: 756185 - protein, 72 aa, Homo sapiens
TKDKDTYMDTVNRYHLTEPERNTSSKLKDCVTDTMTPEETEAVVQQLVSAAGPGHQRHPTALDLLESRDSVP

SEQ ID NO: 756186 - protein, 45 aa, Homo sapiens
MEVPSKPLALFTFNKVCHLFDPASGKNSPGLFAHKTVIPMHHHRP

SEQ ID NO: 756187 - protein, 47 aa, Homo sapiens
VETTVMMQTACFTAAPHQPGPVISLDLSSEKHSIPVLPVSWRRDLKP

SEQ ID NO: 756188 - protein, 120 aa, Homo sapiens [sequence omitted]

SEQ ID NO: 756189 - protein, 120 aa, Homo sapiens [sequence omitted]

SEQ ID NO: 756190 - protein, 1115 aa, Homo sapiens
EQPTTSQPETTTPQGLLSDKDDMGRRNAGIDFGSRKASAAQPIPENMDNSMVSDPQPYHEDAASGAEKTEARASLSLMVESLSTTQEEAILSVAAEAQVFMNPSHIQLEDQEAFSFDLQKAQSKMESAQDVQTICKEKPSGNVHQTFTASVLGMTSTTAKGDVYAKTLPPRSLFQSSRKPDAEEVSSDSENIPEEGDGSEELAHGHSSQSLGKFEDEQEVFSESKSFVEDLSSSEEELDLRCLSQALEEPEDAEVFTESSSYVEKYNTSEDCSSSEEDLPLRHPAQALGKPKNQQEVSSASNNTPEEQNDFMQQLPSRCPSQPIMNPTVQQQVPTSSVGTSIKQSDSVEPIPPRHPFQPWVNPKVEQEVSSSPKSMAVEESISMKPLPPKLLCQPLMNPKVQQNMFSGSEDIAVERVISVEPLLPRYSPQSLTDPQIRQISESTAVEEGTYVEPLPPRCLSQPSERPKFLDSMSTSAEWSSPVAPTPSKYTSPPWVTPKFEELYQLSAHPESTTVEEDISKEQLLPRHLSQLTVGNKVQQLSSNFERAAIEADISGSPLPPQYATQFLKRSKVQEMTSRLEKMAVEGTSNKSPIPRRPTQSFVKFMAQQIFSESSALKRGSDVAPLPPNLPSKSLSKPEVKHQVFSDSGSANPKGGISSKMLPMKHPLQSLGRPEDPQKVFSYSERAPGKCSSFKEQLSPRQLSQALRKPEYEQKVSPVSASSPKEWRNSKKQLPPKHSSQASDRSKFQPQMSSKGPVNVPVKQSSGEKHLPSSSPFQQQVHSSSVNAAARRSVFESNSDNWFLGRDEAFAIKTKKFSQGSKNPIKSIPAPATKPGKFTIAPVRQTSTSGGIYSKKEDLESGDGNNNQHANLSNQDDVEKLFGVRLKRAPPSQKYKSEKQDNFTQLASVPSGPISSSVGRGHKIRSTSQGLLDAAGNLTKISYVADKQQSRPKSESMAKKQPACKTPGKPAGQQSDYAVSEPVWITMAKQKQKSFKAHISVKELKTKSNAGADAETKEPKYEGAGSANENQPKKMFTSSVHKQEKTAQMKPPKPTKSVGFEAQKILQVPAMEKETKRSSTLPAKFQNPVEPIEPVWFSLARKKAKAWSHMAEITQ

SEQ ID NO: 756191 - protein, 72 aa, Homo sapiens
GCSGVQGSQTGTMELSVLLFLALLTGLLLLLVQRHPNSHGTLPPGPRPLPLLGNLLQMDRRGLLKSFLREWI

SEQ ID NO: 756192 - protein, 404 aa, Homo sapiens
GCSGVQGSQTGTMELSVLLFLALLTGLLLLLVQRHPNSHGTLPPGPRPLPLLGNLLQMDRRGLLKSFLRFREKYGDVFTVHLGPRPVVMLCGVEAIREALVDNAEAFSGRGKIVIMDPVYQGYGMLFANGNRWKVLRRFSVTTMRDFGMGKRSVEERIQDEAQCLIEELRKSKGALVDPTFLFHSITANIICSIIFGKRFHYQDQEFLKTLNLFCQSFLLISSISSQLFELFSGFLKYFPGAHRQVYKNLQEINAYIGHSVEKHRETLDPSAPRDLIDTYLLHMEKVRNPTHTVNSATRTSSSTRSRSSLLALRPPAPLSATASCSCSNTLMSQRESTRRLNRWLAHIALQRLMTEPKCHTQRQSSVRFRDLLTFSPWVCPTLSPNTPASEGTPSPRTRKYFSS

SEQ ID NO: 756193 - protein, 110 aa, Homo sapiens
PSLLSIAEKSNPHSEFSHQNLIINTLSLFFAGTETTSTTLRYGFLLMLKYPHVAERVYKEIEQVVGPHRPPALDDRAKMPYTEAVIREIQRFADLLPMGVPHIVTQHTSF

SEQ ID NO: 756194 - protein, 263 aa, Homo sapiens
GCSGVQGSQTGTMELSVLLFLALLTGLLLLLVQRHPNSHGTLPPGPRPLPLLGNLLQMDRRGLLKSFLRFREKYGDVFTVHLGPRPVVMLCGVEAIREALVDNAEAFSGRGKIVIMDPVYQGYGMLFANGNRWKVLRRFSVTTMRDFGMGKRSVEERIQDEAQCLIEELRKSKGALVDPTFLFHSITANIICSIIFGKRFHYQDQEFLKTLNLFCQSFLLISSISSQVQEREKEREGGGEVNIQDTREKDDLTWGLRNAAYPW

SEQ ID NO: 756195 - protein, 404 aa, Homo sapiens; identical to SEQ ID NO: 756192

SEQ ID NO: 756196 - protein, 110 aa, Homo sapiens; identical to SEQ ID NO: 756193

SEQ ID NO: 756197 - protein, 293 aa, Homo sapiens
GCSGVQGSQTGTMELSVLLFLALLTGLLLLLVQRHPNSHGTLPPGPRPLPLLGNLLQMDRRGLLKSFLRFREKYGDVFTVHLGPRPVVMLCGVEAIREALVDNAEAFSGRGKIVIMDPVYQGYGMLFANGNRWKVLRRFSVTTMRDFGMGKRSVEERIQDEAQCLIEELRKSKGALVDPTFLFHSITANIICSIIFGKRFHYQDQEFLKTLNLFCQSFLLISSISSQLFELFSGFLKYFPGAHRQVYKNLQEINAYIGHSVEKHRETLDPSAPRDLIDTYLLHMEKVKERKMR

SEQ ID NO: 756198 - protein, 69 aa, Homo sapiens
PGSSCFPQAACSTPGLVLLRRWAVVVRGSNQYGNGEMAYHACPSPQEGGRGAGEQTPDSWTLAACVMEA

SEQ ID NO: 756199 - protein, 173 aa, Homo sapiens
QPRNTFGQLFCGSLDLFGILCVGLYRIIDEEELNPENKRFVITRPANEFKLLPSDLVFCAIPFSTACYKRNEEFSLQKSYEIVNKASQTTETHSDTNCPPTIDSVTETLYSPVYSYQPRTNSLSFPKQIAWNQSRTNSIISSQIPLGDNAKENERKTSDEVYDEDPFAYSEPL

SEQ ID NO: 756200 - protein, 214 aa, Homo sapiens
MKTKCICELCSCGRHHCPHLPTKIYDETEKPCLLSEYTENYPFYHSYLPRESFKPRREYQKGSIPMEGLTTSRRDFGPHKVAPVKVHQYDQFVPSEENMDLLTTYKKDYNPYPVCRVDPIKPRDSKYPCSDKMECLPTYKADYLPWNQPRREPLRLEHKYQPASVRFDNRTTHQDDYPIKGLVKTISCKPLAMPKLCNIPLEDVTNYKMSYVAH

SEQ ID NO: 756201 - protein, 106 aa, Homo sapiens
SLQQTSWNVPLVKVASLGCGHGKEDEETPSEQNVSVGVSQFKAGSSTLKTQPREIYVPFLKDILPLANLPGREPYLVGARANQYQHQKHHSAKKSLKRDMDRASDH

SEQ ID NO: 756202 - protein, 311 aa, Homo sapiens
SGTRARARAAVDALLSWCAPEPKFQVETAGARGRNAWSMKRQGASSERKRARIPSGKAGAANGFLMEVCVDSVESAVNAERGGADRIELCSGLSEGGTTPSMGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQAKGRIVVMPGGGITDRNLQRILEGSGATEFHCSARSTRDSGMKFRNSSVAMGASLSCSEYSLKVTDVTKVRTLNAIAKNILV

SEQ ID NO: 756203 - protein, 232 aa, Homo sapiens
SGTRARARAAVDALLSWCAPEPKFQVETAGARGRNAWSMKRQGASSERKRARIPSGKAGAANGFLMEVCVDSVESAVNAERGGADRIELCSGLSEGGTTPSMGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQEVV

SEQ ID NO: 756204 - protein, 361 aa, Homo sapiens
SGTRARARAAVDALLSWCAPEPKFQVETAGARGRNAWSMKRQGASSERKRARIPSGKAGAEGGGGGDGRPKAPRGGPAGVVVSGDFFWSRFLSSFQPLGRHLLSLRLKGAANGFLMEVCVDSVESAVNAERGGADRIELCSGLSEGGTTPSMGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQAKGRIVVMPGGGITDRNLQRILEGSGATEFHCSARSTRDSGMKFRNSSVAMGASLSCSEYSLKVTDVTKVRTLNAIAKNILV

SEQ ID NO: 756205 - protein, 276 aa, Homo sapiens
WCGDSRVIPALEIARARIPSGKAGAANGFLMEVCVDSVESAVNAERGGADRIELCSGLSEGGTTPSMGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQAKGRIVVMPGGGITDRNLQRILEGSGATEFHCSARSTRDSGMKFRNSSVAMGASLSCSEYSLKVTDVTKVRTLNAIAKNILV

SEQ ID NO: 756206 - protein, 246 aa, Homo sapiens
MEVCVDSVESAVNAERGGADRIELCSGLSEGGTTPSMGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQAKGRIVVMPGGGITDRNLQRILEGSGATEFHCSARSTRDSGMKFRNSSVAMGASLSCSEYSLKVTDVTKVRTLNAIAKNILV

SEQ ID NO: 756207 - protein, 286 aa, Homo sapiens
SGTRARARAAVDALLSWCAPEPKFQVETAGARGRNAWSMKRQGASSERKRARIPSGKAGAANGFLMEVCVDSVESAVNAERGGADRIELCSGLSEGGTTPSMGVLQVVKQSVQIPVFVMIRPRGGDFLYSDREIEVMKADIRLAKLYAICRPLPVTFHRAFDMVHDPMAALETLLTLGFERVLTSGCDSSALEGLPLIKRLIEQAKGRIVVMPGGGITDRNLQRILEGSGATEFHCSARSTRDSGMKFRNSSVAMGASLSCSEYSLKVTDVTKVRTLNAIAKNILV

SEQ ID NO: 756208 - protein, 271 aa, Homo sapiens
SGTRARARAAVDALLSWCAPEPKFQVETAGARGRNAWSMKRQGASSERKRARIPSGKAGAANGFLMEVCVDSVESAVNAERGGADRIELCSGLSEGGTTPSMGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQKFICCHGSLTFLLRIFPKGNRCDQSKDFECYRKEHPGVARPL

SEQ ID NO: 756209 - protein, 194 aa, Homo sapiens [sequence omitted]

SEQ ID NO: 756210 - protein, 171 aa, Homo sapiens
MQDAPLSCLSPTRWSSVSSADSTEKSASGAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALITDDLTDAIICARKIVKETQGMNY

SEQ ID NO: 756211 - protein, 190 aa, Homo sapiens
MQDAPLSCLSPTRWSSVSSADSTEKSASGAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALITDDLTDAIICARKIVKETCPSGKKAVRFPKLELDPGCFAATP

SEQ ID NO: 756212 - protein, 840 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEESIRGHTLIKN

SEQ ID NO: 756213 - protein, 783 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTVNQISHPFELYGEQMMTDYYSTMSMIISLMFIEHLLC

SEQ ID NO: 756214 - protein, 894 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEKVYLCGQDEEHKHCEDYVCSYNYEGKGSLAGSVGCCSDRQEEEGLEFLDHLEPKFRTLAKTCIKK

SEQ ID NO: 756215 - protein, 130 aa, Homo sapiens
IVRAPWTPVPMTFGARMGGRCRMSLAPLWARNCHPIPRPQPPSYPGPPADPGQDGALQEVRGGDFFAPCASFQSPEGRALPTLGMGRQPLPRGRARGSVQSADSDLCARDSTPPLHSCPSRWDKKCGATS

SEQ ID NO: 756216 - protein, 46 aa, Homo sapiens
MTTVTYSSEVTWQISNNRLNQCRHSLVDKNHLLFLLTRLQLAALYA

SEQ ID NO: 756217 - protein, 149 aa, Homo sapiens
MGAKLCVVKTQRKAKQAETLTQDYIITPHALPMFREPRQRSTRKQLEKDRLDPLKSHKPEPPVAGPGRGGRVGTHGGTLSSYIVKNIALDKTDDSNPREAILRHAKAAEDSPYWVSPAYSKTQPKTMFAQVESDDEEAKNEPEWKKRKI

SEQ ID NO: 756218 - protein, 654 aa, Homo sapiens
MERSGPSEVTGSDASGPDPQLAVTMGFTGFGKKARTFDLEAMFEQTRRTAVERSRKTLEAREKEEEMNREKELRRQNEDIEPTSSRSNVVRDCSKSSSRDTSSSESEQSSDSSDDELIGPPLPPKMVGKPVNFMEEDILGPLPPPLNEEEEEAEEEEEEEEEEENPVHKIPDSHEITLKHGTKTVSALGLDPSGARLVTGGYDYDVKFWDFAGMDASFKAFRSLQPCECHQIKSLQYSNTGDMILVVSGSSQAKVIDRDGFEVMECIKGDQYIVDMANTKGHTAMLHTGSWHPKIKGEFMTCSNDATVRTWEVENPKKQKSVFKPRTMQGKKVIPTTCTYSRDGNLIAAACQNGSIQIWDRNLTVHPKFHYKQAHDSGTDTSCVTFSYDGNVLASRGGDDSLKLWDIRQFNKPLFSASGLPTMFPMTDCCFSPDDKLIVTGTSIQRGCGSGKLVFFERRTFQRVYEIDITDASVVRCLWHPKLNQIMVGTGNGLAKVYYDPNKSQRGAKLCVVKTQRKAKQAETLTQDYIITPHALPMFREPRQRSTRKQLEKDRLDPLKSHKPEPPVAGPGRGGRVGTHGGTLSSYIVKNIALDKTDDSNPREAILRHAKAAEDSPYWVSPAYSKTQPKTMFAQVESDDEEAKNEPEWKKRKI

SEQ ID NO: 756219 - protein, 412 aa, Homo sapiens
MILVVSGSSQAKVIDRDGFEVMECIKGDQYIVDMANTKGHTAMLHTGSWHPKIKGEFMTCSNDATVRTWEVENPKKQKSVFKPRTMQGKKVIPTTCTYSRDGNLIAAACQNGSIQIWDRNLTVHPKFHYKQAHDSGTDTSCVTFSYDGNVLASRGGDDSLKLWDIRQFNKPLFSASGLPTMFPMTDCCFSPDDKLIVTGTSIQRGCGSGKLVFFERRTFQRVYEIDITDASVVRCLWHPKLNQIMVGTGNGLAKVYYDPNKSQRGAKLCVVKTQRKAKQAETLTQDYIITPHALPMFREPRQRSTRKQLEKDRLDPLKSHKPEPPVAGPGRGGRVGTHGGTLSSYIVKNIALDKTDDSNPREAILRHAKAAEDSPYWVSPAYSKTQPKTMFAQVESDDEEAKNEPEWKKRKI

SEQ ID NO: 756220 - protein, 750 aa, Homo sapiens
MEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 756221 - protein, 856 aa, Homo sapiens
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 756222 - protein, 738 aa, Homo sapiens
MNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 756223 - protein, 836 aa, Homo sapiens
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKVETGFHHVSQDGLDLLTS

SEQ ID NO: 756224 - protein, 828 aa, Homo sapiens
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGKWIHSLSSS

SEQ ID NO: 756225 - protein, 477 aa, Homo sapiens
MERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 756226 - protein, 328 aa, Homo sapiens
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGRFSLCCPG

SEQ ID NO: 756227 - protein, 659 aa, Homo sapiens
MEDYPDPQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 756228 - protein, 856 aa, Homo sapiens; identical to SEQ ID NO: 756221

SEQ ID NO: 756229 - protein, 284 aa, Homo sapiens
YARYEAGCADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 756230 - protein, 71 aa, Homo sapiens
QTQISKSHVFEGLCERTVGLSRENISASCKAQTGKGPANQEQHSGDSEIKLTTEGTLCFPSPRLRKPRRAR

SEQ ID NO: 756231 - protein, 642 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVEKHLEEQIAKVDREYEECMSEDLSENIKEIRDKYEKKATLIKSSEE

SEQ ID NO: 756232 - protein, 642 aa, Homo sapiens; identical to SEQ ID NO: 756231

SEQ ID NO: 756233 - protein, 602 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVERRMLG

SEQ ID NO: 756234 - protein, 488 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQ

SEQ ID NO: 756235 - protein, 490 aa, Homo sapiens
MASCAPHTNFLTQSLKKRFQESLKTLAHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVEKHLEEQIAKVDREYEECMSEDLSENIKEIRDKYEKKATLIKSSEE

SEQ ID NO: 756236 - protein, 163 aa, Homo sapiens [sequence omitted]

SEQ ID NO: 756237 - protein, 150 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKMKQRKRMKNVPVSLSPWRNTSTC

SEQ ID NO: 756238 - protein, 199 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKVFDLFF

SEQ ID NO: 756239 - protein, 85 aa, Homo sapiens
LRASCVMTSAPAENFKFERLWRAEEGPGVLMTAVLSSRYLHGLQKFGPWVVSGNWKKGHKHEAQFSFQRWCWPPLHAGVKIPGCK

SEQ ID NO: 756240 - protein, 247 aa, Homo sapiens
GFEVLKSFWILSPEDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQ

SEQ ID NO: 756241 - protein, 642 aa, Homo sapiens; identical to SEQ ID NO: 756231

SEQ ID NO: 756242 - protein, 527 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKVRTLPQFA

SEQ ID NO: 756243 - protein, 85 aa, Homo sapiens; identical to SEQ ID NO: 756239

SEQ ID NO: 756244 - protein, 420 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAVCHTISRVATHHS

SEQ ID NO: 756245 - protein, 231 aa, Homo sapiens
RTRGSTHASKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVEKHLEEQIAKVDREYEECMSEDLSENIKEIRDKYEKKATLIKSSEE

SEQ ID NO: 756246 - protein, 200 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGEPFGVFLFLHLLPKKLPLYHKLGGLPQYNGPSHFVTPLSFG

SEQ ID NO: 756247 - protein, 82 aa, Homo sapiens
LVRAGFKSAPNFKFERLWRAEEGPGVLMTAVLSSRYLHGLQKFGPWVVSGNWKKGHKHEAQFSFQRWCWPPLHAGVKIPGCK

SEQ ID NO: 756248 - protein, 633 aa, Homo sapiens
MPLTPTVQGFQWTLRGPDVETSPFGAPRAASHGVGRHQELRDPTVPGPTSSATNVSMVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRNLQESEEEEAPQESWDEGDWTLSIPPDMSASYQSDRSTFHSVEEQQVGLALDIGRHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDNRFFTLTVIRHHLAFQMGVIFPH

SEQ ID NO: 756249 - protein, 69 aa, Homo sapiens
GSEAEYFRSQRPVKFHCPALGPKVVVVWVIRGLPGTVQRARCAVLAWLGMAAEVPFSWCFVVAAEDQFC

SEQ ID NO: 756250 - protein, 680 aa, Homo sapiens [sequence omitted]

SEQ ID NO: 756251 - protein, 278 aa, Homo sapiens
MLPQIPFLLLVSLNLVHGVFYAERYQTPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGPPGVGKRGENGVPGQPGIKGDRGFPGEMGPIGPPGPQGPPGERGPSQMAYTPLSMSTPLSQDS

SEQ ID NO: 756252 - protein, 680 aa, Homo sapiens [sequence omitted]

SEQ ID NO: 756253 - protein, 680 aa, Homo sapiens [sequence omitted]

SEQ ID NO: 756254 - protein, 147 aa, Homo sapiens
MGFIFSKSMNESMKNQKEFMLMNARLQLERQLIMQSEMRERQMAMQIAWSREFLKYFGTFFGLAAISLTAGAIKKKKPAFLVPIVPLSFILTYQYDLGYGTLLERMKGEAEDILETEKSKLQLPRGMITFESIEKARKEQSRFFIDK

SEQ ID NO: 756255 - protein, 147 aa, Homo sapiens; identical to SEQ ID NO: 756254

SEQ ID NO: 756256 - protein, 147 aa, Homo sapiens; identical to SEQ ID NO: 756254

SEQ ID NO: 756257 - protein, 147 aa, Homo sapiens; identical to SEQ ID NO: 756254

SEQ ID NO: 756258 - protein, 114 aa, Homo sapiens
MQSEMRERQMAMQIAWSREFLKYFGTFFGLAAISLTAGAIKKKKPAFLVPIVPLSFILTYQYDLGYGTLLERMKGEAEDILETEKSKLQLPRGMITFESIEKARKEQSRFFIDK

SEQ ID NO: 756259 - protein, 145 aa, Homo sapiens
PPPPINPPLPPLLVKEKKKKSYMNALERQLIMQSEMRERQMAMQIAWSREFLKYFGTFFGLAAISLTAGAIKKKKPAFLVPIVPLSFILTYQYDLGYGTLLERMKGEAEDILETEKSKLQLPRGMITFESIEKARKEQSRFFIDK

SEQ ID NO: 756260 - protein, 114 aa, Homo sapiens; identical to SEQ ID NO: 756258

SEQ ID NO: 756261 - protein, 147 aa, Homo sapiens; identical to SEQ ID NO: 756254

SEQ ID NO: 756262 - protein, 147 aa, Homo sapiens; identical to SEQ ID NO: 756254

SEQ ID NO: 756263 - protein, 130 aa, Homo sapiens
MGFIFSKSMNESMKNQKEFMLMNARLQLERQLIMQSEMRERQMAMQIAWSREFLKYFGTFFGLAAISLTAGAIKKKKPAFLVPIVPLSFILTYQYDLGYGTLLERMKGEAEDILETEKTRKEQSRFFIDK

SEQ ID NO: 756264 - protein, 385 aa, Homo sapiens
MAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 756265 - protein, 222 aa, Homo sapiens
HASRTAWVDPRVRAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQGGVS

SEQ ID NO: 756266 - protein, 385 aa, Homo sapiens; identical to SEQ ID NO: 756264

SEQ ID NO: 756267 - protein, 385 aa, Homo sapiens; identical to SEQ ID NO: 756264

SEQ ID NO: 756268 - protein, 366 aa, Homo sapiens
MAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKDEPQEPQEPNKVPLEDTETDELWASLEAAAKRKLSGLEQPQGALQTRRRKKKRPGSTSP

SEQ ID NO: 756269 - protein, 437 aa, Homo sapiens
MYSSDLHKQAPPGFIFVKQNKHGSFTVSALQTSSNYTALHRTRRPLVTHTLRRKCELSASRLCHGGCCCTLEPWVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 756270 - protein, 387 aa, Homo sapiens
HASRTAWVDPRVRWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 756271 - protein, 399 aa, Homo sapiens
MAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPVRLPCPDGWGRWAGLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 756272 - protein, 153 aa, Homo sapiens
MTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 756273 - protein, 238 aa, Homo sapiens [sequence omitted]

SEQ ID NO: 756274 - protein, 211 aa, Homo sapiens
MYSSDLHKQAPPGFIFVKQNKHGSFTVSALQTSSNYTALHRTRRPLVTHTLRRKCELSASRLCHGGCCCTLEPCVGRHRDWDLERGKSSAKTGGELHGRRTAAARGGSERPVLGHRRRDPDAGGLRGQDGEALQHRGWHIPGSETLPGRGGHDEPQEPQEPNKVPLEDTETDELWASLEAAAKRKLSGLEQPQGALQTRRRKKKRPGSTSP

SEQ ID NO: 756275 - protein, 79 aa, Homo sapiens
TLGKGGLRTLERTLISYSLQDEPQEPQEPNKVPLEDTETDELWASLEAAAKRKLSGLEQPQGALQTRRRKKKRPGSTSP

SEQ ID NO: 756276 - protein, 128 aa, Homo sapiens
PRGAMGCCQDKDFEMSDEQSKEEESEDGREDETTDTQRGPRECERGLPEGRGELRGLVVPSGAEDIDLNSPDHPNHKSNESLLITVLWRRLSTFGRRGSSRPSKRQPDQIRKQESPIREGNQEEPEKG

SEQ ID NO: 756277 - protein, 385 aa, Homo sapiens; identical to SEQ ID NO: 756264

SEQ ID NO: 756278 - protein, 385 aa, Homo sapiens; identical to SEQ ID NO: 756264

SEQ ID NO: 756279 - protein, 385 aa, Homo sapiens; identical to SEQ ID NO: 756264

SEQ ID NO: 756280 - protein, 328 aa, Homo sapiens
MLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 756281 - protein, 323 aa, Homo sapiens
MAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIPEFGYIQRSGRHMQDIESDIVELGL

SEQ ID NO: 756282 - protein, 250 aa, Homo sapiens
MRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 756283 - protein, 210 aa, Homo sapiens
MAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQGGVS

SEQ ID NO: 756284 - protein, 192 aa, Homo sapiens
MTLTPGGNSVIVGNTHGQLAEIDLRQGRLLGCLKGLAGSVRGLQCHPSKPLLASCGLDRVLRIHRIQNPRGLEHKVSCLSHLQLMVLWRPRLLCPPFMFLSQHAWLLKVPHLLQVYLKSQLNCLLLSGRDNWEDEPQEPQEPNKVPLEDTETDELWASLEAAAKRKLSGLEQPQGALQTRRRKKKRPGSTSP

SEQ ID NO: 756285 - protein, 143 aa, Homo sapiens
MVGYWPASYHGCFPPSLGRLLGCLKGLAGSVRGLQCHPSKPLLASCGLDRVLRIHRIQNPRGLEHKVSCLSHLQLMVLWRPRLLCPPFMFLSQHAWLLKVPHLLQVYLKSQLNCLLLSGRDNWEVSSWARECGSQGHRCEDLP

SEQ ID NO: 756286 - protein, 142 aa, Homo sapiens
ADRSSWYPPTSPTGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSG

SEQ ID NO: 756287 - protein, 375 aa, Homo sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 756288 - protein, 375 aa, Homo sapiens; identical to SEQ ID NO: 756287

SEQ ID NO: 756289 - protein, 232 aa, Homo sapiens
ADRSSWYPPTSPTGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 756290 - protein, 285 aa, Homo sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSG

SEQ ID NO: 756291 - protein, 45 aa, Homo sapiens
MVTYSLECMILGANGDTSRMQALSGEIVFGCTGVGAFTVVGSFGP

SEQ ID NO: 756292 - protein, 375 aa, Homo sapiens; identical to SEQ ID NO: 756287

SEQ ID NO: 756293 - protein, 385 aa, Homo sapiens [sequence omitted]

SEQ ID NO: 756294 - protein, 42 aa, Homo sapiens
MECTRAPGSNSQKGCPARRLHRNLLTEATVRRNTGRDARFLW

SEQ ID NO: 756295 - protein, 427 aa, Homo sapiens [sequence omitted]

SEQ ID NO: 756296 - protein, 581 aa, Homo sapiens [sequence omitted]

SEQ ID NO: 756297 - protein, 581 aa, Homo sapiens [sequence omitted]

SEQ ID NO: 756298 - protein, 139 aa, Homo sapiens
MHHAVYPAVNRFSPSPRNSPRPSPKQSPRNSPRSRSPARGIEYSRVSPQPMISRLQQPRLSLQGHPTDLQTSNVKNEEKLRRSLPNLSRTSNTQVDSVKSSRSDSNFQVPNGGIPRMQPQASASKYPSYAFMYQLFKEK

SEQ ID NO: 756299 - protein, 581 aa, Homo sapiens [sequence omitted]

SEQ ID NO: 756300 - protein, 581 aa, Homo sapiens [sequence omitted]

SEQ ID NO: 756301 - protein, 341 aa, Homo sapiens
MEDVNSNVNADQEVRKLQELVKKLEKQNEQLRSRSGAVQGAGSLGPGSPVRAGASIPSSGAASPRGFPLGLSAKSGGGPGSGPRRTSSEELRDATSLLAAGEGGLLDEVEPLRPDELERLSGWEEEEESWLYSSPKKKLTPMQKSVSPLVWCRQVLDYPSPDVECAKKSLIHKLDQTMSALKRQNLYNNPFNSMSYTSPYSPNASSPYSSGFNSPSSTPVRPPIVKQLILPGNSGNLKSSDRNPPLSPQSSIDSELSASELDEDSIGSNYKLNDVTDVQILARMQEESLRQEYAATTSRRSSGSSCNSTRRGFHHHHAIHLDRHLSSHPEIHLVHDLLLGE

SEQ ID NO: 756302 - protein, 581 aa, Homo sapiens [sequence omitted]

SEQ ID NO: 756303 - protein, 147 aa, Homo sapiens [sequence omitted]

SEQ ID NO: 756304 - protein, 469 aa, Homo sapiens
MEDVNSNVNADQEVRKLQELVKKLEKQNEQLRSRSGAVQGAGSLGPGSPVRAGASIPSSGAASPRGFPLGLSAKSGGGPGSGPRRTSSEELRDATSLLAAGEGGLLDEVEPLRPDELERLSGWEEEEESWLYSSPKKKLTPMQKSVSPLVWCRQVLDYPSPDVECAKKSLIHKLDQTMSALKRQNLYNNPFNSMSYTSPYSPNASSPYSSGFNSPSSTPVRPPIVKQLILPGNSGNLKSSDRNPPLSPQSSIDSELSASELDEDSIGSNYKLNDVTDVQILARMQEESLRQEYAATTSRRSSGSSCNSTRRGTFSDQELDAQSLDDEDDNMHHAVYPAVNRFSPSPRNSPRPSPKQSPRNSPRSRSPARGIEYSRVSPQPMISRLQQPRLSLQGHPTDLQTSNVKNEEKLRRSLPNLSRTSNTQVDSVKSSRSDSNFQVPNGGIPRMQPQASASKYPSYAFMYQLFKEK

SEQ ID NO: 756305 - protein, 581 aa, Homo sapiens [sequence omitted]

SEQ ID NO: 756306 - protein, 201 aa, Homo sapiens
MISRLQQPRLSLQGHPTDLQTSNVKNEEKLRRSLPNLSRTSNTQVDSVKSSRSDSNFQVPNGGIPRMQPQASAIPSPGKFRSPAAPSPLALRQPVKAFSNHGSGSPGSQEITQLTQTTSSPGPPMVQSTVSANPPSNINSATLTRPAGTTAMRSGLPRPSAPSAGGIPVPRSKLAQPVRRSLPAPKTYGSMKDDSWKDGCY

SEQ ID NO: 756307 - protein, 581 aa, Homo sapiens [sequence omitted]

SEQ ID NO: 756308 - protein, 110 aa, Homo sapiens
LGFFSPALWLDRKNPLFLGGFLFFPPKAPNLNLVSSFLAGRQAFTDFLCLPAKSSANWILAASLLSCSCFRSGFHRDSRVFLVQLAEGLSHSLETVSSHSVWSFRPTPRQ

SEQ ID NO: 756309 - protein, 112 aa, Homo sapiens [sequence omitted]

SEQ ID NO: 756310 - protein, 71 aa, Homo sapiens
LYNLFRQMEAEGTVPNSFCEASFTLIPKPVKDITRKENYRPISLINIDAKSPTKYSHMLHSDVLVNDRPYT

SEQ ID NO: 756311 - protein, 646 aa, Homo sapiens
APQRPSCSPGSVSAAAVNMEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGAVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 756312 - protein, 201 aa, Homo sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEVPLGWTLAPGSWRRRGQGPGLLGLREEGLGTPG

SEQ ID NO: 756313 - protein, 269 aa, Homo sapiens
APQRPSCSPGSVSAAAVNMEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEAHKRHTCPTRGPCGIPQRDTVTMKTIPGDRPPVPSRPRAPRSPTTPRVYAPPGRRLCRPVDACPPRADSHVRPQVPGRSGPCSPAPGTPLTRLPGGPARARYPDADPLSAWPEGP

SEQ ID NO: 756314 - protein, 628 aa, Homo sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGAVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 756315 - protein, 588 aa, Homo sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGAVSPQTSQAGVAVMAVAVSVGLLLLVVAVFYCVRRKGGPCCRQRREKGAP

SEQ ID NO: 756316 - protein, 183 aa, Homo sapiens
MNGQLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQ

SEQ ID NO: 756317 - protein, 326 aa, Homo sapiens [sequence omitted]

SEQ ID NO: 756318 - protein, 375 aa, Homo sapiens
VRPRVYRPRPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 756319 - protein, 366 aa, Homo sapiens
MRGWVLIGRGAVLIAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 756320 - protein, 254 aa, Homo sapiens
LGGGRCKSDEVTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 756321 - protein, 376 aa, Homo sapiens
KRGTKHKNQVGTTGETLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRRW

SEQ ID NO: 756322 - protein, 326 aa, Homo sapiens [sequence omitted]

SEQ ID NO: 756323 - protein, 326 aa, Homo sapiens [sequence omitted]

SEQ ID NO: 756324 - protein, 326 aa, Homo sapiens [sequence omitted]

SEQ ID NO: 756325 - protein, 326 aa, Homo sapiens [sequence omitted]

SEQ ID NO: 756326 - protein, 326 aa, Homo sapiens [sequence omitted]

SEQ ID NO: 756327 - protein, 326 aa, Homo sapiens [sequence omitted]

SEQ ID NO: 756328 - protein, 326 aa, Homo sapiens [sequence omitted]

SEQ ID NO: 756329 - protein, 326 aa, Homo sapiens [sequence omitted]

SEQ ID NO: 756330 - protein, 326 aa, Homo sapiens [sequence omitted]

SEQ ID NO: 756331 - protein, 326 aa, Homo sapiens [sequence omitted]

SEQ ID NO: 756332 - protein, 326 aa, Homo sapiens [sequence omitted]

SEQ ID NO: 756333 - protein, 326 aa, Homo sapiens [sequence omitted]

SEQ ID NO: 756334 - protein, 326 aa, Homo sapiens [sequence omitted]

SEQ ID NO: 756335 - protein, 326 aa, Homo sapiens [sequence omitted]

SEQ ID NO: 756336 - protein, 267 aa, Homo sapiens [sequence omitted]

SEQ ID NO: 756337 - protein, 289 aa, Homo sapiens
KRGTKHKNQVGTTGETLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGPSRDYTKVDRSCFA

SEQ ID NO: 756338 - protein, 146 aa, Homo sapiens
MNGQLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQVSWCRGCFNLF

SEQ ID NO: 756339 - protein, 395 aa, Homo sapiens
MNGQLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 756340 - protein, 326 aa, Homo sapiens [sequence omitted]

SEQ ID NO: 756341 - protein, 407 aa, Homo sapiens
KRGTKHKNQVGTTGETLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 756342 - protein, 422 aa, Homo sapiens
MNGQLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQVSWCRGCFNLFYIKFWSLITLVTFLSLGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 756343 - protein, 359 aa, Homo sapiens
KRGTKHKNQVGTTGETLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 756344 - protein, 291 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 756345 - protein, 190 aa, Homo sapiens
MKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 756346 - protein, 208 aa, Homo sapiens
MKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQELEAGAAGRLVRPRARRRRGLCPLHRRRPLERRRLPEALPLGLRDRAGQGQPGATSPLIYFFNASTCRRGPGLGIRPSGGLFCFLGNFHLGF

SEQ ID NO: 756347 - protein, 237 aa, Homo sapiens
MKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQVRTRRVWEAGWPRRDHHPPSLSSEICPAPHRPCEHLDGPPRPRTGGRSSRTTGTATGSEEARTVPTSPTTAAGTTTSARGPTAGSARQSWTRPARSHLSFNLFLQCLDLPQGSGIGNPPIWGPLLLSREFSSRILREGEG

SEQ ID NO: 756348 - protein, 240 aa, Homo sapiens
KQFVSDLRSLSCQMAALQGNGKEASPARSLPPPFSGQRLAPAPRFSRSGSERTCCPVNWVEHERSCYWFSRSGKAWADADNYCRLEDAHLVVVTSWEEQVRTRRVWEAGWPRRDHHPPSLSSEICPAPHRPCEHLDGPPRPKRALEVGGRDGLRDGLQVSARPPSAWVRPPSRPGALGWGVWSDPPADPTSWGPQLALSPGNWRPEQPDDWYGHGLGGGEDCAHFTDDGRWNDDVCQRPY

SEQ ID NO: 756349 - protein, 291 aa, Homo sapiens; identical to SEQ ID NO: 756344

SEQ ID NO: 756350 - protein, 291 aa, Homo sapiens; identical to SEQ ID NO: 756344

SEQ ID NO: 756351 - protein, 248 aa, Homo sapiens
MKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQVRTRRVWEAGWPRRDHHPPSLSSEICPAPHRPCEHLDGPPRPKRALEVGGRDGLRDGLQELEAGAAGRLVRPRARRRRGLCPLHRRRPLERRRLPEALPLGLRDRAGQGQPGATSPLIYFFNASTCRRGPGLGIRPSGGLFCFLGNFHLGF

SEQ ID NO: 756352 - protein, 291 aa, Homo sapiens; identical to SEQ ID NO: 756344

SEQ ID NO: 756353 - protein, 72 aa, Homo sapiens
GFRGLEGSAAAKMQLLQECLCYPKRNRCTKRRNEMLGDILSRKPANRLFPEDLLRLGQAAVYKSRTVLRFEL

SEQ ID NO: 756354 - protein, 415 aa, Homo sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 756355 - protein, 444 aa, Homo sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRPGCTHWGDQADGALEVGAPWSGAPFQVRRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 756356 - protein, 141 aa, Homo sapiens [sequence omitted]

SEQ ID NO: 756357 - protein, 375 aa, Homo sapiens
MGGHPQLRLVKALLLLGLNPVSASLQDQHCESLSLASNISDNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 756358 - protein, 401 aa, Homo sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQVRSAIRKRWHRWQDKHSIRARVARAMSIPTSPTRVSFHSIKQSTAV

SEQ ID NO: 756359 - protein, 475 aa, Homo sapiens
MQKSTNSDTSVETLNSTRQGTGAVQMRIKNANSHHDRLSQSKSMILTDVGKVTEPISRHRRNHSQHILKDVIPPLEQLMVEKEGYLQKAKIADGGKKLRKNWSTSWIVLSSRRIEFYKESKQQALSNMKTGHKPESVDLCGAHIEWAKEKSSRKNVFQITTVSGNEFLLQSDIDFIILDWFHAIKNAIDRLPKDSSCPSRNLELFKIQRSSSTELLSHYDSDIKEQKPEHRKSLMFRLHHSASDTSDKNRVKSRLKKFITRRPSLKTLQEKGLIKDQIFGSHLHKVCERENSTVPWFVKQCIEAVEKRGLDVDGIYRVSGNLATIQKLRFIVNQEEKLNLDDSQWEDIHVVTGALKMFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 756360 - protein, 152 aa, Homo sapiens
WGTGRLVLCKQEEKLNLDDSQWEDIHVVTGALKMFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 756361 - protein, 274 aa, Homo sapiens
MQKSTNSDTSVETLNSTRQGTGAVQMRIKNANSHHDRLSQSKSMILTDVGKVTEPISRHRRNHSQHILKDVIPPLEQLMVEKEGYLQKAKIADGGKKLRKNWSTSWIVLSSRRIEFYKESKQQALSNMKTGHKPESVDLCGAHIEWAKEKSSRKNVFQITTVSGNEFLLQSDIDFIILDWFHAIKNAIDRLPKDSSCPSRNLELFKIQRSSSTELLSHYDSDIKEQKPEHRKSLMFRLHHSASDTSDKNRVKSRLKKFITPKTFPENSARKRTY

SEQ ID NO: 756362 - protein, 348 aa, Homo sapiens
MKTGHKPESVDLCGAHIEWAKEKSSRKNVFQITTVSGNEFLLQSDIDFIILDWFHAIKNAIDRLPKDSSCPSRNLELFKIQRSSSTELLSHYDSDIKEQKPEHRKSLMFRLHHSASDTSDKNRVKSRLKKFITRRPSLKTLQEKGLIKDQIFGSHLHKVCERENSTVPWFVKQCIEAVEKRGLDVDGIYRVSGNLATIQKLRFIVNQEEKLNLDDSQWEDIHVVTGALKMFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 756363 - protein, 404 aa, Homo sapiens
MEEMKNEAETTSMVSMPLYAVMYPVFNEKNWSTSWIVLSSRRIEFYKESKQQALSNMKTGHKPESVDLCGAHIEWAKEKSSRKNVFQITTVSGNEFLLQSDIDFIILDWFHAIKNAIDRLPKDSSCPSRNLELFKIQRSSSTELLSHYDSDIKEQKPEHRKSLMFRLHHSASDTSDKNRVKSRLKKFITRRPSLKTLQEKGLIKDQIFGSHLHKVCERENSTVPWFVKQCIEAVEKRGLDVDGIYRVSGNLATIQKLRFIVNQEEKLNLDDSQWEDIHVVTGALKMFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 756364 - protein, 119 aa, Homo sapiens
MFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 756365 - protein, 119 aa, Homo sapiens; identical to SEQ ID NO: 756364

SEQ ID NO: 756366 - protein, 475 aa, Homo sapiens; identical to SEQ ID NO: 756359

SEQ ID NO: 756367 - protein, 274 aa, Homo sapiens; identical to SEQ ID NO: 756361

SEQ ID NO: 756368 - protein, 274 aa, Homo sapiens; identical to SEQ ID NO: 756361

SEQ ID NO: 756369 - protein, 239 aa, Homo sapiens
MQKSTNSDTSVETLNSTRQGTGAVQMRIKNANSHHDRLSQSKSMILTDVGKVTEPISRHRRNHSQHILKDVIPPLEQLMVEKEGYLQKAKIADGGKKLRKNWSTSWIVLSSRRIEFYKESKQQALSNMKTGHKPESVDLCGAHIEWAKEKSSRKNVFQITTVSGNEFLLQSDIDFIILDWFHAIKNAIDRLPKDSSCPSRNLELFKIQRSSSTELLSHYDSDIKEQKPEHRKSLSEYFL

SEQ ID NO: 756370 - protein, 153 aa, Homo sapiens
MRPGTALQAVLLAVLLVGLRAATGRLLSGECARWGGGWCRGGLTAPQLLLTLFWVATYGTRRPSHAPLPDAALRSLLRSGGSRTASETHASSRSCAVPCASWNARSPFPVQSYGGGLENVGEVGQWANLPQWVPLRPAPLHASNQSLGPPPRG

SEQ ID NO: 756371 - protein, 374 aa, Homo sapiens
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 756372 - protein, 348 aa, Homo sapiens
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVENEIYGY

SEQ ID NO: 756373 - protein, 382 aa, Homo sapiens
MRPGTALQAVLLAVLLVGLRAATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 756374 - protein, 229 aa, Homo sapiens
MVTSGLGSGGVRRNKAIAQPARTFMLGLMAAYHNLEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 756375 - protein, 374 aa, Homo sapiens; identical to SEQ ID NO: 756371

SEQ ID NO: 756376 - protein, 536 aa, Homo sapiens
MSRPPREAVVKSWLAASSPPRARVRHEARATPPHPSPGDWPCVGHFLTAGPPGRAGQPGGRAAWQSLRMDPLGDTLRRLREAFHAGRTRPAEFRAAQLQGLGRFLQENKQLLHDALAQDLHKSAFESEVSEVAISQGEVTLALRNLRAWMKDERVPKNLATQLDSAFIRKEPFGLVLIIAPWNYPLNLTLVPLVGALAAGNCVVLKPSEISKNVEKILAEVLPQYVDQSCFAVVLGGPQETGQLLEHRFDYIFFTGSPRVGKIVMTAAAKHLTPVTLELGGKNPCYVDDNCDPQTVANRVAWFRYFNAGQTCVAPDYVLCSPEMQERLLPALQSTITRFYGDDPQSSPNLGRIINQKQFQRLRALLGCGRVAIGGQSDESDRYIAPTVLVDVQEMEPVMQEEIFGPILPIVNVQSLDEAIEFINRREKPLALYAFSNSSQVVKRVLTQTSSGGFCGNDGFMHMTLASLPFGGVGASGMGRYHGKFSFDTFSHHRACLLRSPGMEKLNALRYPPQSPRRLRMLLVAMEAQGCSCTLL

SEQ ID NO: 756377 - protein, 831 aa, Homo sapiens
MSAPFLPTLFPEPVGTHSEHPGWHSAQHMGTCVLFLEARGLERKWLVLPWPPGQRKQPLSSSPNDVATPPHPRSCRSGPNAPQPVMGGHAPETLGPISPWTSVAQPQEARGSLRPHNLSSVGSGSNSEEGGRGNGIQTARDLPSPVTPPTAGLPESTQPWVLPSRPQPSVPSPKDLAAHPQGTVREVGAEVDSLLLFWIWVFQCEELGGIRQALALSEASASISFSGVNSGPSVGGRGGEMSEGRHGDHTPYNLTLWDECRWGWAWGTPAQCLIQEFPILCVHNGCPAPSGDNRPRIPPISGRRRPWLLRLPGSCPGHSLGASVQSELTRRGNARAGCPVGEMCPVALVSWFQQLLGGLLECSLQNSIPHRAPGPQSTIHVTCLAFLWFLQRFLQRVREAQAWFAFDHWQKSEGESRMEKDPGECGVEGDKYLQATYKTPRADLCRVLSVGTTANVLCSVMSFNPHNDTRCHYHPHFTDEETEAEKVSDLPKVPQPVRGRALETGLMVAREARSWLLGLSPAPVTSHPLWGPWCLSCVRATAQLLPIRAGRWWVQPGPTITPAEGWPGAPDQALSSTLVQQGHPADRSRSRPQGGHLTITHSLALTDAGPWAQNRLCGLIISWQVPSLHREHERLQALGLKEVGTEGPASQSNEGEIREMWTGLGGGKSVTRHLSHGTTQNAGEQSQGATVTVDEGIIWVGCLEEASAKLDLEERDSEREGGKGHHGSLAPGRGTSASECSSDELQVNRQGSGECLGPYPACQLWLAPARRQERPLPSALIPPPAFPSQLQERGPTKAAVAQNIQPGPSLWTWSPPCPHPQQAASAQRHVH

SEQ ID NO: 756378 - protein, 115 aa, Homo sapiens
MKDERVPKNLATQLDSAFIRKEPFGLVLIIAPWNYPLNLTLVPLVGALAAGNCVVLKPSEISKNVEKILAEVLPQYVDQSCFAVVLGGPQETGQLLEHRFDYIFFTALPWLLLSF

SEQ ID NO: 756379 - protein, 499 aa, Homo sapiens
MSRPPREAVVKSWLAASSPPRARVRHEARATPPHPSPGDWPCVGHFLTAGPPGRAGQPGGRAAWQSLRMDPLGDTLRRLREAFHAGRTRPAEFRAAQLQGLGRFLQENKQLLHDALAQDLHKATQLDSAFIRKEPFGLVLIIAPWNYPLNLTLVPLVGALAAGNCVVLKPSEISKNVEKILAEVLPQYVDQSCFAVVLGGPQETGQLLEHRFDYIFFTGSPRVGKIVMTAAAKHLTPVTLELGGKNPCYVDDNCDPQTVANRVAWFRYFNAGQTCVAPDYVLCSPEMQERLLPALQSTITRFYGDDPQSSPNLGRIINQKQFQRLRALLGCGRVAIGGQSDESDRYIAPTVLVDVQEMEPVMQEEIFGPILPIVNVQSLDEAIEFINRREKPLALYAFSNSSQVVKRVLTQTSSGGFCGNDGFMHMTLASLPFGGVGASGMGRYHGKFSFDTFSHHRACLLRSPGMEKLNALRYPPQSPRRLRMLLVAMEAQGCSCTLL

SEQ ID NO: 756380 - protein, 431 aa, Homo sapiens
MDPLGDTLRRLREAFHAGRTRPAEFRAAQLQGLGRFLQENKQLLHDALAQDLHKATQLDSAFIRKEPFGLVLIIAPWNYPLNLTLVPLVGALAAGNCVVLKPSEISKNVEKILAEVLPQYVDQSCFAVVLGGPQETGQLLEHRFDYIFFTGSPRVGKIVMTAAAKHLTPVTLELGGKNPCYVDDNCDPQTVANRVAWFRYFNAGQTCVAPDYVLCSPEMQERLLPALQSTITRFYGDDPQSSPNLGRIINQKQFQRLRALLGCGRVAIGGQSDESDRYIAPTVLVDVQEMEPVMQEEIFGPILPIVNVQSLDEAIEFINRREKPLALYAFSNSSQVVKRVLTQTSSGGFCGNDGFMHMTLASLPFGGVGASGMGRYHGKFSFDTFSHHRACLLRSPGMEKLNALRYPPQSPRRLRMLLVAMEAQGCSCTLL

SEQ ID NO: 756381 - protein, 536 aa, Homo sapiens; identical to SEQ ID NO: 756376

SEQ ID NO: 756382 - protein, 272 aa, Homo sapiens
MTAAAKHLTPVTLELGGKNPCYVDDNCDPQTVANRVAWFRYFNAGQTCVAPDYVLCSPEMQERLLPALQSTITRFYGDDPQSSPNLGRIINQKQFQRLRALLGCGRVAIGGQSDESDRYIAPTVLVDVQEMEPVMQEEIFGPILPIVNVQSLDEAIEFINRREKPLALYAFSNSSQVVKRVLTQTSSGGFCGNDGFMHMTLASLPFGGVGASGMGRYHGKFSFDTFSHHRACLLRSPGMEKLNALRYPPQSPRRLRMLLVAMEAQGCSCTLL

SEQ ID NO: 756383 - protein, 298 aa, Homo sapiens
MSRPPREAVVKSWLAASSPPRARVRHEARATPPHPSPGDWPCVGHFLTAGPPGRAGQPGGRAAWQSLRMDPLGDTLRRLREAFHAGRTRPAEFRAAQLQGLGRFLQENKQLLHDALAQDLHKSAFESEVSEVAISQGEVTLALRNLRAWMKDERVPKNLATQLDSAFIRKEPFGLVLIIAPWNYPLNLTLVPLVGALAAGNCVVLKPSEISKNVEKILAEVLPQYVDQSCFAVVLGGPQETGQLLEHRFDYIFFTGSPRVGKIVMTAAAKHPSKQRLPPPSWVFPLPASASSLSRSQP

SEQ ID NO: 756384 - protein, 536 aa, Homo sapiens; identical to SEQ ID NO: 756376

SEQ ID NO: 756385 - protein, 123 aa, Homo sapiens
MTAVACGWWRRGLGSRARGGKGLPRLQGTPQSSACLLPPGSSLSLPQPPPSAAPNHESRGGRHGKQCSDSPPAPAPTTHIQEKRTDTAPLSHPSPVERASEGPWHLTQATPWNHCIQGHSCPL

SEQ ID NO: 756386 - protein, 136 aa, Homo sapiens [sequence omitted]

SEQ ID NO: 756387 - protein, 136 aa, Homo sapiens [sequence omitted]

SEQ ID NO: 756388 - protein, 409 aa, Homo sapiens
MSLHAWEWEEDPASIEPISSITSFYQSTSECDVEEHLKAKARAQESDSDRPCSSIESSSEPASTFSSDVPHVVPCKFTISLAFPVNMGQKGKYASLIEKYKKHPKTDSSVTKMRRFYHIEYFLLPDDEEPKKVDILLFPMVAKVFLESGVKTVKPWHEGDKAWVSWEQTFNITVTKELLKKINFHKITLRLWNTKDKMSRKVRYYRLKTAGFTDDVGAFHKSEVRHLVLNQRKLSEQGIENTNIVREESNQEHPPGKQEKTEKHPKSLQGSHQAEPETSSKNSEEYEKSLKMDDSSTIQWSVSRTPTISLAGASMMEIKELIESESLSSLTNILDRQRSQIKGKDSEGRRKIQRRHKKPLAEEEADPTLTGPRKQSAFSIQLAVMPLLAGTHCLPCSQQLLLVLWPERP

SEQ ID NO: 756389 - protein, 297 aa, Homo sapiens
MRRFYHIEYFLLPDDEEPKKVDILLFPMVAKVFLESGVKTVKPWHEGDKAWVSWEQTFNITVTKELLKKINFHKITLRLWNTKDKMSRKVRYYRLKTAGFTDDVGAFHKSEVRHLVLNQRKLSEQGIENTNIVREESNQEHPPGKQEKTEKHPKSLQGSHQAEPETSSKNSEEYEKSLKMDDSSTIQWSVSRTPTISLAGASMMEIKELIESESLSSLTNILDRQRSQIKGKDSEGRRKIQRRHKKPLAEEEADPTLTGPRKQSAFSIQLAVMPLLAGTHCLPCSQQLLLVLWPERP

SEQ ID NO: 756390 - protein, 109 aa, Homo sapiens
MGLRPSLHRRTLLSVLESLRPGGCGSGTGVAAAVQLPAAAQRIRSSSLPVPTACPVPSSSCLSCGQNGHKRMLLMTTLLRATSFHPHSHLRKLRGIGFIVQGETKAQRG

SEQ ID NO: 756391 - protein, 152 aa, Homo sapiens
IVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQG

SEQ ID NO: 756392 - protein, 149 aa, Homo sapiens
LSGWGGRLNSHSESSPPKLRGFLTFLFREPQKYNADYDLSAQQGADTLAFMSLLEEKLIPVLVHTFWIDTKNYVEVTRKWYAEAMPFPLNFFLPGRMQRQYMERLQLLTGEHRPEDEEELEKELYREARECLTLLSQRLGSQKFFFGDA

SEQ ID NO: 756393 - protein, 87 aa, Homo sapiens
WGWLQRALGTIEMAASQLPSLLQPGTAALAQACGMFQKLKCPLSGPYPSLEHNGLCLKGSGFVIPQVSQRINSFRGCPSAAPIHGYF

SEQ ID NO: 756394 - protein, 917 aa, Homo sapiens
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 756395 - protein, 917 aa, Homo sapiens; identical to SEQ ID NO: 756394

SEQ ID NO: 756396 - protein, 653 aa, Homo sapiens
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREVGDTWHEV

SEQ ID NO: 756397 - protein, 917 aa, Homo sapiens; identical to SEQ ID NO: 756394

SEQ ID NO: 756398 - protein, 134 aa, Homo sapiens
LYCPGEYRDDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 756399 - protein, 917 aa, Homo sapiens; identical to SEQ ID NO: 756394

SEQ ID NO: 756400 - protein, 917 aa, Homo sapiens; identical to SEQ ID NO: 756394

SEQ ID NO: 756401 - protein, 256 aa, Homo sapiens
MMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 756402 - protein, 917 aa, Homo sapiens; identical to SEQ ID NO: 756394

SEQ ID NO: 756403 - protein, 108 aa, Homo sapiens
SPKLEYCGIIPAHCSLDLLGSDDLPVSASQVAGTTGTHLAKFLEIQVLPYCPGWSQTPEFKRSSQLGFPKCWGYRHEPPCPARKYLLNCIGTSRNISQTKQDLMKRTP

SEQ ID NO: 756404 - protein, 480 aa, Homo sapiens [sequence omitted]

SEQ ID NO: 756405 - protein, 452 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPVTSRSTSTWRIPSRKRRKSN

SEQ ID NO: 756406 - protein, 522 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPVTSRSTSTWRIPSRKRRFSSSDFSDLSNGEELQETCSSSLRRGSGVPRSQEARTESSQASDMMDTMDVENNSTLEKHSGKRNGVLLRGPD

SEQ ID NO: 756407 - protein, 452 aa, Homo sapiens; identical to SEQ ID NO: 756405

SEQ ID NO: 756408 - protein, 211 aa, Homo sapiens
FRTHASDQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPVTSRSTSTWRIPSRKRRFSSSDFSDLSNGEELQETCSSSLRRGSGVPRSQEARTESSQASDMMDTMDVENNSTLEKHSGKRNGVLLRGPD

SEQ ID NO: 756409 - protein, 452 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTGPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPVTSRSTSTWRIPSRKRRFSSSDFSDLSNGEELQETCSSSLRRGSGKED

SEQ ID NO: 756410 - protein, 542 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPVTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRNGVLLRGPD

SEQ ID NO: 756411 - protein, 240 aa, Homo sapiens
STSIVECPDHARSHHIQACDMIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPVTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRNGVLLRGPD

SEQ ID NO: 756412 - protein, 428 aa, Homo sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFDCTCGIVWLKTWALTTAVSIPEQDNIACTSPHVLKGTPLSRLPPLPCSAPSVQLSYQPSQDGAELRPGFVLALHCDVDGQPAPQLHWHIQIPSGIVEITSPNVGTDGRALPGTPVASSQPRFQAFANGSLLIPDFGKLEEGTYSCLATNELGSAESSVDVALATPGEGGEDTLGRRFHGKAVEGKGCYTVDNEVQPSGPEDNVVIIYLSRAGNPEAAVAEGVPGQLPPGLLLLGQSLLLFFFLTSF

SEQ ID NO: 756413 - protein, 428 aa, Homo sapiens; identical to SEQ ID NO: 756412

SEQ ID NO: 756414 - protein, 428 aa, Homo sapiens; identical to SEQ ID NO: 756412

SEQ ID NO: 756415 - protein, 492 aa, Homo sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFDCTCGIVWLKTWALTTAVSIPEQDNIACTSPHVLKGTPLSRLPPLPCSAPSVQLSYQPSQDGAELRPGFVLALHCDVDGQPAPQLHWHIQIPSGIVEITSPNVGTDGRALPGTPVASSQPRFQAFANGSLLIPDFGKLEEGTYSCLATNELGSAESSVDVALATPGEGGEDTLGRRFHGKAVEGKGCYTVDNEVQPSGPEDNVVIIYLSRAGNPEAAVAEGVPGQLPPGLLLLGQSLLLFFFLLPPLCCPPLCCPSTEEVWGIGSGGMWVSTHREAHRDEPLGIPCWRLVEGCAHLPCFPSSVPPLWYLR

SEQ ID NO: 756416 - protein, 268 aa, Homo sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFDCTCGIVWLKTWALTTAVSIPEQDNIACTSPHVLKGTPLSRLPPLPCSAPSVQLSYQPSQDGAERTGPLGRDCTDCFKKMADKPDM

SEQ ID NO: 756417 - protein, 149 aa, Homo sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAEQKVDAEQ

SEQ ID NO: 756418 - protein, 81 aa, Homo sapiens
VPGLRVFTIITGHPQETLNLEYFRGRSSASSFQGILTTRWVLAFQVLEGGSRATRGRNLTPETFQRLISWWNFRGRQSRST

SEQ ID NO: 756419 - protein, 531 aa, Homo sapiens
GAAAATAAATAVLEPRAGELAGGSTDRRTHAEALRPQPRAGATAARPRPPVQPPLARCLGARPHTASCSAPGSAMRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 756420 - protein, 451 aa, Homo sapiens
DPSTLFFFPVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 756421 - protein, 328 aa, Homo sapiens [sequence omitted]

SEQ ID NO: 756422 - protein, 531 aa, Homo sapiens; identical to SEQ ID NO: 756419

SEQ ID NO: 756423 - protein, 531 aa, Homo sapiens; identical to SEQ ID NO: 756419

SEQ ID NO: 756424 - protein, 329 aa, Homo sapiens
GAAAATAAATAVLEPRAGELAGGSTDRRTHAEALRPQPRAGATAARPRPPVQPPLARCLGARPHTASCSAPGSAMRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKRAGGGAALQGVGGLQTLEQDGPAGQGADG

SEQ ID NO: 756425 - protein, 380 aa, Homo sapiens
GAAAATAAATAVLEPRAGELAGGSTDRRTHAEALRPQPRAGATAARPRPPVQPPLARCLGARPHTASCSAPGSAMRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKGRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 756426 - protein, 440 aa, Homo sapiens
GAAAATAAATAVLEPRAGELAGGSTDRRTHAEALRPQPRAGATAARPRPPVQPPLARCLGARPHTASCSAPGSAMRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEKKEEEGSANRRPEDQELESLSAIEAELEKVAHQLQALRRG

SEQ ID NO: 756427 - protein, 531 aa, Homo sapiens; identical to SEQ ID NO: 756419

SEQ ID NO: 756428 - protein, 498 aa, Homo sapiens
GAAAATAAATAVLEPRAGELAGGSTDRRTHAEALRPQPRAGATAARPRPPVQPPLARCLGARPHTASCSAPGSAMRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQSLPKPRPPYRPLRALSPTPDSYLPWNILCRAAPQL

SEQ ID NO: 756429 - protein, 120 aa, Homo sapiens
FFRGKSPEQIYFSLDKVHTEYVTVRSSQLSPKGQKLLQLCPVDRKKEGKLLESCLCSEKECQCLKFEAGLPLQVRGYPEEKKEEEGSANRRPEDQELESLSAIEAELEKVAHQLQALRRG

SEQ ID NO: 756430 - protein, 330 aa, Homo sapiens
GAAAATAAATAVLEPRAGELAGGSTDRRTHAEALRPQPRAGATAARPRPPVQPPLARCLGARPHTASCSAPGSAMRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGALASSPQILSGFSLGFPGFVDGSCVSRYKPDIIFPPGLPPPDLPSSGSIFYLQLLWFSWSLAGITGVWTLVIIFKLGLLPSFPTS

SEQ ID NO: 756431 - protein, 69 aa, Homo sapiens
MPLARLARVNPNVSPRTRSWRACRPLRQSWRKWPTSCRHYGGAETPAGRAGPRAPCGPGSAVPLAGPGQ

SEQ ID NO: 756432 - protein, 102 aa, Homo sapiens
SSGVGRAESWSSEGLSQGLVDREKGLSAEPGWQAKREEEEEEEEEAEAGEEAVPEEEGPTVVLNPHPSLGYKEIRKGESRSEALAVDGAGTSFAGQPHNFKH

SEQ ID NO: 756433 - protein, 531 aa, Homo sapiens; identical to SEQ ID NO: 756419

SEQ ID NO: 756434 - protein, 149 aa, Homo sapiens
MAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 756435 - protein, 250 aa, Homo sapiens
MLQSGVLSFHQKVRSYCSCAQEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 756436 - protein, 457 aa, Homo sapiens
GAAAATAAATAVLEPRAGELAGGSTDRRTHAEALRPQPRAGATAARPRPPVQPPLARCLGARPHTASCSAPGSAMRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKKEEEGSANRRPEDQELESLSAIEAELEKVAHQLQALRRG

SEQ ID NO: 756437 - protein, 531 aa, Homo sapiens; identical to SEQ ID NO: 756419

SEQ ID NO: 756438 - protein, 554 aa, Homo sapiens
GAAAATAAATAVLEPRAGELAGGSTDRRTHAEALRPQPRAGATAARPRPPVQPPLARCLGARPHTASCSAPGSAMRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEMARTLLPVGRQPPACPSPGHPIAPYAPCLLLLTPTCPGTSFAGQPHNFKH

SEQ ID NO: 756439 - protein, 74 aa, Homo sapiens
EEGGSANRRPEDQELESLLGEAGLPLQVRGYPEEKKEEEGSANRRPEDQELESLSAIEAELEKVAHQLQALRRG

SEQ ID NO: 756440 - protein, 532 aa, Homo sapiens
GAAAATAAATAVLEPRAGELAGGSTDRRTHAEALRPQPRAGATAARPRPPVQPPLARCLGARPHTASCSAPGSAMRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFLVVGEVMLDDAVDAVSDVMLCSNGCWCDDDSITAWMQDWTMLCQMELDWLEEGCAWDVCARDVTCRDVTYLWNIVPLKASFLGALGPTVLHVCALVACWLADEGLDGHPSPGDGSAFEAVACPLQVRGLPPEEKTDGVVAV

SEQ ID NO: 756441 - protein, 82 aa, Homo sapiens
RHYGGAETPAGRAGPRAPCGPGSAVPLAGPGQMARTLLPVGRQPPACPSPGHPIAPYAPCLLLLTPTCPGTSFAGQPHNFKH

SEQ ID NO: 756442 - protein, 350 aa, Homo sapiens
MNSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLNKLDSLCVSFAYINCCINPIIYVVAGQGFQGRLRKSLPSLLRNVLTEESVVRESKSFTRSTVDTMAQKTQAV

SEQ ID NO: 756443 - protein, 304 aa, Homo sapiens
KCWLSCPRGTSLTGIQSSGRRIRLRSGTVRGSPLDSTRSCLRLPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLNKLDSLCVSFAYINCCINPIIYVVAGQGFQGRLRKSLPSLLRNVLTEESVVRESKSFTRSTVDTMAQKTQAV

SEQ ID NO: 756444 - protein, 122 aa, Homo sapiens
SWDYRQVQPRLANFCIFSRDGVLPCCPGYSQTPGLKQSARLGLPKCWDDRRELRHLPQYFNKWCDTLVDSQPSASPFPSEKKPHRGKATCLSQDAPYPGTCLQTHPLCSLRFPLELLQLYHP

SEQ ID NO: 756445 - protein, 350 aa, Homo sapiens; identical to SEQ ID NO: 756442

SEQ ID NO: 756446 - protein, 108 aa, Homo sapiens
MREIVHIQAGQRGNQIGAKFWEVISDEHGIDPTGTYHGDSDLQLDRISVYYSEATDGKYVPRAILVDLEPGTMDSVRSGPFGQIFRPDNFVFGQSGAEPPSPQASQFP

SEQ ID NO: 756447 - protein, 125 aa, Homo sapiens
MREIVHIQAGQRGNQIGAKFWEVISDEHGIDPTGTYHGDSDLQLDRISVYYSEATDGKYVPRAILVDLEPGTMDSVRSGPFGQIFRPDNFVFGQSGAGNNWAKGHYTEGAELVSVATRSVPSSGR

SEQ ID NO: 756448 - protein, 217 aa, Homo sapiens
SSRTNLPDTFRRETTSSHILSQAAPPQGENWNPEKRAGGRSRIEDPPGCRLWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 756449 - protein, 592 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 756450 - protein, 308 aa, Homo sapiens
RSSSYPTLLHLRHKNPKTGIYEEKHAKRPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 756451 - protein, 592 aa, Homo sapiens; identical to SEQ ID NO: 756449

SEQ ID NO: 756452 - protein, 262 aa, Homo sapiens
PSDMAQGMDSERDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 756453 - protein, 396 aa, Homo sapiens
RSSSYPTLLHLRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRSL

SEQ ID NO: 756454 - protein, 120 aa, Homo sapiens [sequence omitted]

SEQ ID NO: 756455 - protein, 304 aa, Homo sapiens
RSSSYPTLLHLRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILKTDQWYGV

SEQ ID NO: 756456 - protein, 319 aa, Homo sapiens
RSSSYPTLLHLRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKVGSFFF

SEQ ID NO: 756457 - protein, 81 aa, Homo sapiens
VDSKIPLVCRSDVKEEEEEKEEEKDKGDEEEEGEEKLEEKQKSDAEEDGGTVSQEEEDRKPKAEEDEILNRSPRNRKPRRE

SEQ ID NO: 756458 - protein, 592 aa, Homo sapiens; identical to SEQ ID NO: 756449

SEQ ID NO: 756459 - protein, 78 aa, Homo sapiens
VVVIRGSGAKQLPKTDAPQPDVKEEEEEKEEEKDKGDEEEEGEEKLEEKQKSDAEEDGGTVSQEEKDKGDEEEEVAKG

SEQ ID NO: 756460 - protein, 287 aa, Homo sapiens
GTRPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 756461 - protein, 592 aa, Homo sapiens; identical to SEQ ID NO: 756449

SEQ ID NO: 756462 - protein, 240 aa, Homo sapiens
RSSSYPTLLHLRHKNPKTGIYEEKHAKRPDEEATKPEGWLDDEPEYVPDPDAEKPEDYLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 756463 - protein, 356 aa, Homo sapiens
RSSSYPTLLHLRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMGARRVHAHAECPNTHTLPILQGFSVAFIPASPRPLFN

SEQ ID NO: 756464 - protein, 375 aa, Homo sapiens
RSSSYPTLLHLRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEHNKILRHLNRIRRTTQRRAGDETGGLDEDGSRENLGVRDDSGAREGILKNTAMRD

SEQ ID NO: 756465 - protein, 281 aa, Homo sapiens
RSSSYPTLLHLRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDTQGTTKTMMGIRARTPRADVT

SEQ ID NO: 756466 - protein, 255 aa, Homo sapiens
MEDEQPDSLEGWVPVREGLFAEPERHRLRFLVAWNGAEGKFAVTCHDRTAQQRRLREGARLGPEPEPKPEAAVSPSSWAGLLSAAGLRGAHRQLAALWPPLERCFPRLPPELDVGGGGAWGLGLGLWALLWPTRAGPGEAALQELCGQLERYLGAAADGCGGATVRDALFPAEGGAADCESPREFRERALRARWVEADARLRQVIQGHGKANTMVALMNVYQEEDEAYQELVTVATMFFQYLLQPFRAMREVATL

SEQ ID NO: 756467 - protein, 626 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 756468 - protein, 624 aa, Homo sapiens
MSKEAVSLWALTVSLQPPVPLCVCREMTGSGRRKQQCVTLPFISRELCFYLLLFPPPRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 756469 - protein, 583 aa, Homo sapiens
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 756470 - protein, 545 aa, Homo sapiens
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGATAILAYLPQELLGTSCYEYFHQDDIGHLAECHRQVLQTREKITTNCYKFKIKDGSFITLRSRWFSFMNPWTKEVEYIVSTNTVVLSRVDTGHLGQVERCTVLSRPDSRFLIAGDVHRANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 756471 - protein, 497 aa, Homo sapiens
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKVLQTREKITTNCYKFKIKDGSFITLRSRWFSFMNPWTKEVEYIVSTNTVVLSRVDTGHLGQVERCTVLSRPDSRFLIAGDVHRANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 756472 - protein, 408 aa, Homo sapiens
MKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLSRVDTGHLGQVERCTVLSRPDSRFLIAGDVHRANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 756473 - protein, 224 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKR

SEQ ID NO: 756474 - protein, 626 aa, Homo sapiens; identical to SEQ ID NO: 756467

SEQ ID NO: 756475 - protein, 583 aa, Homo sapiens; identical to SEQ ID NO: 756469

SEQ ID NO: 756476 - protein, 626 aa, Homo sapiens; identical to SEQ ID NO: 756467

SEQ ID NO: 756477 - protein, 408 aa, Homo sapiens; identical to SEQ ID NO: 756472

SEQ ID NO: 756478 - protein, 291 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADAGLGGPVDFSDLPWPL

SEQ ID NO: 756479 - protein, 322 aa, Homo sapiens
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKKSSAGCEGIGDFVELLGGTGLDPSKMTPLADLCYPFHGPAQMKVGCDNTVVRMVSSGKHVNRVTFEYRQLEPYELENPNGNSIGEFCLSGL

SEQ ID NO: 756480 - protein, 356 aa, Homo sapiens
RWGYPGLMERVKTFPSSPDTGKHYPSLFIRYAEWQGGCPAPGPLFYPQPLNFSGLTYVSCQLREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKKSSAGCEGIGDFVELLGGTGLDPSKMTPLADLCYPFHGPAQMKVGCDNTVVRMVSSGKHVNRVTFEYRQLEPYELENPNGNSIGEFCLSGL

SEQ ID NO: 756481 - protein, 223 aa, Homo sapiens
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVINPQQVARE

SEQ ID NO: 756482 - protein, 288 aa, Homo sapiens
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKKSSAGCEGIGDFVELLGGTGLDPSKMTPLADLCYPFHGPVLFRTSPECNLSCVEWMG

SEQ ID NO: 756483 - protein, 322 aa, Homo sapiens; identical to SEQ ID NO: 756479

SEQ ID NO: 756484 - protein, 316 aa, Homo sapiens
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKKSSAGCEGIGDFVELLGGTGLDPSKMTPLADLCYPFHGPAQMKVGCDNTVVRMVSSGKHVNRVTFEYRQLEPYELNQPSDLHADS

SEQ ID NO: 756485 - protein, 102 aa, Homo sapiens
MCLSLLLYSLRKSSAGCEGIGDFVELLGGTGLDPSKMTPLADLCYPFHGPAQMKVGCDNTVVRMVSSGKHVNRVTFEYRQLEPYELENPNGNSIGEFCLSGL

SEQ ID NO: 756486 - protein, 76 aa, Homo sapiens
QEEEWQLLSRTQQRAGASEGTGQGQGSESAMVIDEDFLGARGLVRLGQGSESAVVIDEDILGARGLVRLGQASESA

SEQ ID NO: 756487 - protein, 119 aa, Homo sapiens
MESGQEAHPSASPAPAPARLHLPSCDQLRTSGCSGAMPRYTVHVRGEWLAVPCQDAQLTVGWLGREAVRRYIKNKPDNGGFTSVDDAHFLVRRCKGLGLLDNEDRLEVALENNEFVEVV

SEQ ID NO: 756488 - protein, 657 aa, Homo sapiens [sequence omitted]

SEQ ID NO: 756489 - protein, 228 aa, Homo sapiens [sequence omitted]

SEQ ID NO: 756490 - protein, 327 aa, Homo sapiens
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQGIEFLRPLKTTTPLEKVYDLVRSVVRPWIKDRFMAPDIEAAHRLLLEQKVWEVAAPYIEKYRMEHIPESRPLSPTAFSLQFLHKKSTKIPESEDL

SEQ ID NO: 756491 - protein, 657 aa, Homo sapiens [sequence omitted]

SEQ ID NO: 756492 - protein, 212 aa, Homo sapiens [sequence omitted]

SEQ ID NO: 756493 - protein, 622 aa, Homo sapiens
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETISGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRPWIKDRFMAPDIEAAHRLLLEQKASWLLGLFLNF

SEQ ID NO: 756494 - protein, 439 aa, Homo sapiens [sequence omitted]

SEQ ID NO: 756495 - protein, 302 aa, Homo sapiens
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYHKASFNVSSLMNCWELP

SEQ ID NO: 756496 - protein, 778 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 756497 - protein, 233 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALNSHSGLLFTSIAKSRSKGKVRT

SEQ ID NO: 756498 - protein, 778 aa, Homo sapiens; identical to SEQ ID NO: 756496

SEQ ID NO: 756499 - protein, 749 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 756500 - protein, 868 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALCFIPVGSAAPQGSP

SEQ ID NO: 756501 - protein, 901 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALVRLQPTAQLWLHSEPDGRWGTGTGGHLGFFTERSAGRLGYSARLAEL

SEQ ID NO: 756502 - protein, 661 aa, Homo sapiens
MTTRQATKDPLLRGVSPTPSKIPVRSQKRTPFPTVTSCAVDQENQDPRGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 756503 - protein, 314 aa, Homo sapiens
MVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 756504 - protein, 285 aa, Homo sapiens
MVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 756505 - protein, 264 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRDLQLRPGASREFWHSPLWGGNKGAN

SEQ ID NO: 756506 - protein, 144 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTVLVPAPGKLFALRRSPFPPAKCHLARCHGLYL

SEQ ID NO: 756507 - protein, 126 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTGAMACTCNHSYSGG

SEQ ID NO: 756508 - protein, 126 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTGTCWSHGNTASMAE

SEQ ID NO: 756509 - protein, 125 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTAKCHLARCHGLYL

SEQ ID NO: 756510 - protein, 689 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756511 - protein, 689 aa, Homo sapiens; identical to SEQ ID NO: 756510

SEQ ID NO: 756512 - protein, 668 aa, Homo sapiens
RTGVVCPCGTDGETEASIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756513 - protein, 645 aa, Homo sapiens
GDCGGSPEVPLKKIFYQKLRYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756514 - protein, 875 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHVSGLGWGMESHAPCCSSPGSWACGLAGRGRSGDVCPLAPRAVAMGVRAGIPAWGGRSRYICGKDGQDMGMGTLAWGQPLLPRCLCPRAGQRQPVVTAAVAAPQLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756515 - protein, 534 aa, Homo sapiens
KARYEAGVNRPRTDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756516 - protein, 333 aa, Homo sapiens [sequence omitted]

SEQ ID NO: 756517 - protein, 689 aa, Homo sapiens; identical to SEQ ID NO: 756510

SEQ ID NO: 756518 - protein, 471 aa, Homo sapiens
KARYEAGCESAEDGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756519 - protein, 349 aa, Homo sapiens
MIPEDKTKASPGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756520 - protein, 296 aa, Homo sapiens
RGSLIGSRIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756521 - protein, 166 aa, Homo sapiens
QKRFTAIAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756522 - protein, 159 aa, Homo sapiens
MHGYMSKMGNPFLTQWQRRYFYLFPNRLEWRGEGEAPVRSPAGVREPGFRVAGRPGSYLHHPSLALQQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756523 - protein, 105 aa, Homo sapiens
DAWVDPRVRGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756524 - protein, 136 aa, Homo sapiens
GEYLRFGIWQRLARGEPAQAECIQASPYFPHKPFSELQGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756525 - protein, 601 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPGSPPEGGWTACEAFRQLGPRLGGAQGPRFWAGVSEAYGRFPLHSGGGAR

SEQ ID NO: 756526 - protein, 529 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGLRR

SEQ ID NO: 756527 - protein, 431 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMALECRSFPEIVLVEGVRGVFRG

SEQ ID NO: 756528 - protein, 600 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKMAANMYRVGDYVYFENSSSNPDLIRRIEELNKTANGNVEAKVVCFYRRRDISSTLIALADKHAREIEEEMENPEMVDLPEKLKHQLRHRELFLSRQLESLPATHIRGKCSVTLLNETESLKSYLEREDFFFYSLVYDPQQKTLLADKGEIRVGNRYQADITELLKEGEEDGRDQSRSETQVWEQHNPLTDKQIDQFLE

SEQ ID NO: 756529 - protein, 314 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYASAAKSSFIHQGIR

SEQ ID NO: 756530 - protein, 297 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHSDHERLPACFAIIGLEALLCRGANRLPRV

SEQ ID NO: 756531 - protein, 276 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRILPAGRTVDAQRSSMSTLQA

SEQ ID NO: 756532 - protein, 72 aa, Homo sapiens
GQAGWGEPQLTELGLAVQSDPELVQWKKELRDAYREAQQLVQRVPKMKNKPRSPVVELSKVPLVQRGSANGL

SEQ ID NO: 756533 - protein, 689 aa, Homo sapiens; identical to SEQ ID NO: 756510

SEQ ID NO: 756534 - protein, 647 aa, Homo sapiens
MQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756535 - protein, 802 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPVRSPAGVREPGFRVAGRPGSYLHHPSLALQQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756536 - protein, 584 aa, Homo sapiens
ELGLAYYVLKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756537 - protein, 540 aa, Homo sapiens [sequence omitted]

SEQ ID NO: 756538 - protein, 689 aa, Homo sapiens; identical to SEQ ID NO: 756510

SEQ ID NO: 756539 - protein, 689 aa, Homo sapiens; identical to SEQ ID NO: 756510

SEQ ID NO: 756540 - protein, 192 aa, Homo sapiens
GIDKQPVFIDATSLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756541 - protein, 220 aa, Homo sapiens
MVKPCLYQKIPKKLAGHGGTRLYSQLPGRLRREDRLNLGGGGCSEPRLCHSPPAWATEWRPCLKTKKKPRWGRLSLLCLSPQDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756542 - protein, 109 aa, Homo sapiens
SIGAEVRLGVSPSLALQQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 756543 - protein, 588 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPLPPAGSPPNERGKGETAGLEPPFFEQFVGFPFWLGGDG

SEQ ID NO: 756544 - protein, 292 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIERVALAAGAATLPAVPSCPNPQHPGSGTTARHLQVGPYWPRLA

SEQ ID NO: 756545 - protein, 481 aa, Homo sapiens
RRRRRPDCSPGGSGAEPGPGPSRRHGAAPPVSGGERTAGAEQGQAGGVGARGRASRGRAGPSAERAGAAAAAAAAGGGSAAAKMADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGAACVVSRLLPPGAGLAHPPLPSTHSPGRFFADF

SEQ ID NO: 756546 - protein, 358 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKGERPCCPQAGPPWLSSPSSRHPGHQAQRSGAPGTWPPRI

SEQ ID NO: 756547 - protein, 174 aa, Homo sapiens
DVGWLQVPVDHEAVVHVLQAQDDLGRKKRMSASEKTPCQPTSFWTSMATCGSRTWAWPVTSPRRSPMPASTPSAQDGAGQVGGQHSKEAGWGLSVCPPSWPISVPPPRLASPTAHVLSVPPPRPPHAPSCQSRCLCGVAPSPPRGWVGAPSPPVYSFPGAFLCRFLNVILKSEK

SEQ ID NO: 756548 - protein, 54 aa, Homo sapiens
MVFRHLCPPMCPCPIHLVKLLDSDQELYRNFPLTISERWQQEVAETVFDTINAE

SEQ ID NO: 756549 - protein, 76 aa, Homo sapiens
IKKYEKLETEEERVARSREIFDSYIMKELLACSHVSVLSWPCVLAQSHLQIGRGREDPAENSWPPLSSPALLEECH

SEQ ID NO: 756550 - protein, 111 aa, Homo sapiens
PEQRDLHTETPSWAPGTMAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 756551 - protein, 124 aa, Homo sapiens
RGRRLAREQSLPWDLGSPLSPQRNSLSAAAPSSGCRGHWGPPAPKHLRHGEVTVCRQGCFCRSLNSRRTGSGLNAWAPQHPAVTELWLEGEGVDAENQGRVQFLVLSSKFFRLWARELVSQGES

SEQ ID NO: 756552 - protein, 91 aa, Homo sapiens
TRRPIKAAVPGARLIRGDGLRALIDGVRGRRQMTAFGLGIPTFLVMQPSGSQPRFPALTQNGVALVRTPLTSVYLRVREPAHMTVWRKFFP

SEQ ID NO: 756553 - protein, 123 aa, Homo sapiens
TRRPIKAAVPGARLIRGDGLRALIDGVRGRRQMTAFGLGIPTFLVMQPSGSQPRFPALTQNGVALVRTPLTSVYLRVRPILPAGLCLGVTLPELAPTTVATVMLMCDCCQEPAHMTVWRKFFP

SEQ ID NO: 756554 - protein, 107 aa, Homo sapiens
ALGFSCLLPAPRGSSGNVCWGLGIPTFLVMQPSGSQPRFPALTQNGVALVRTPLTSVYLRVRPILPAGLCLGVTLPELAPTTVATVMLMCDCCQEPAHMTVWRKFFP

SEQ ID NO: 756555 - protein, 107 aa, Homo sapiens; identical to SEQ ID NO: 756554

SEQ ID NO: 756556 - protein, 107 aa, Homo sapiens; identical to SEQ ID NO: 756554

SEQ ID NO: 756557 - protein, 107 aa, Homo sapiens; identical to SEQ ID NO: 756554

SEQ ID NO: 756558 - protein, 1114 aa, Homo sapiens
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLCIDLGWKPNGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 756559 - protein, 110 aa, Homo sapiens
HRDDRSQDPCEEMVLAMLGALHPRAGLSLFLHLILAVALLRSQPLRSQRSVPEAFSAPLELSQPLSGLVDDYGILPKHPRPRGPRPLLSRAQQRKRDGPDLAEYYYDAHL

SEQ ID NO: 756560 - protein, 240 aa, Homo sapiens
QREDSALGGGRAGRPSRGAFSSSVARRRRPSPSCRAGSPASWGARSSRWRAGIRLEPTEDRAPAGRVRRCRRPAVGRPRAFPSVPRGVPRLSRVPLGSRDPPGPRGCGSTRVPSVGFLGAESLERPRRCPPPPCRTPPSRLRCREALAARLSRALGSFSPGTELSFVQPSPGKMHLLSKSLALPPAADRRSRISSWNAAKVTLFIMGAKVYSVQCGLVPSYNELEDPLWGEKKGLKNRFP

SEQ ID NO: 756561 - protein, 435 aa, Homo sapiens
MWAPPAAIMGDGPTKKVGNQAPLQTQALQTASLRDGPAKRAVWVRHTSSEPQEPTESKAAKERPKQEVTKAVVVDLGTGYCKCGFAGLPRPTHKISTTVGKPYMETAKTGDNRKETFVGQELNNTNVHLKLVNPLRHGIIVDWDTVQDIWEYLFRQEMKIAPEEHAVLVSDPPLSPHTNREKYAEMLFEAFNTPAMHIAYQSRLSMYSYGRTSGLVVEVGHGVSYVVPIYEGYPLPSITGRLDYAGSDLTAYLLGLLNSAGNEFTQDQMGIVEDIKKKCCFVALDPIEEKKVPLSEHTIRYVLPDGKEIQLCQERFLCSEMFFKPSLIKSMQLGLHTQTVSCLNKCDIALKRDLMGNILLCGGSTMLSGFPNRLQKELSSMCPNDTPQVNVLPERDSAVWTGGSILASLQGFQPLWVHRFEYEEHGPFFLYRRCF

SEQ ID NO: 756562 - protein, 165 aa, Homo sapiens
MEMFQGLLLLLLLSMGGTWASKEPLRPRCRPINATLAVEKEGCPVCITVNTTICAGYCPTMTRVLQGVLPALPQVVCHYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 756563 - protein, 165 aa, Homo sapiens
MEMFQGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 756564 - protein, 276 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKENRWNPQGRGCSEPRYTPLHSSLGDRARLRL

SEQ ID NO: 756565 - protein, 209 aa, Homo sapiens
MLPLVLSDRSLSVLRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASVCGKTMQSHPVV

SEQ ID NO: 756566 - protein, 111 aa, Homo sapiens
REDPVSGTERSEPRKLMDLECSRDGLMYEQYRMDSGNTRDMTLIHGYFGSTQGLSDELAKQLWMVLQRSLVTVRRDPTLLVSVVRIIEREEKIDRLQCLTRLQCLTRLQCL

SEQ ID NO: 756567 - protein, 745 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 756568 - protein, 745 aa, Homo sapiens; identical to SEQ ID NO: 756567

SEQ ID NO: 756569 - protein, 819 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEVGLALSSCRFLGRSQCFLTALWDTGCELYRADAVWGAGLCTCIPIRSLKAPPFSVTLLRMMQGPSYAQFSKIHPQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 756570 - protein, 673 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSEDTWSQAGLGLAHGHPTGEETTTSPPWLPASRVWFLFTNILQQYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 756571 - protein, 326 aa, Homo sapiens
DPEVTIAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 756572 - protein, 739 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPCSPLHSLGPCL

SEQ ID NO: 756573 - protein, 296 aa, Homo sapiens [sequence omitted]

SEQ ID NO: 756574 - protein, 662 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDNAIVSSRYLTS

SEQ ID NO: 756575 - protein, 216 aa, Homo sapiens
MRREALIGEVSTGEGVALARGHSTKHNTGRRGQIKDRRLRGARRPLAHPPSRKSTPHYTTGYSTPAERGRGRYTTVKGRSGVLWQPRWMAGDPAEGGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 756576 - protein, 564 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMLDDGDP

SEQ ID NO: 756577 - protein, 431 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQI

SEQ ID NO: 756578 - protein, 150 aa, Homo sapiens
MQTQPRARSRSREGGSERRVPLGLSAPGEMDRPVGVGVGWQTVVGSIGRARARGQARAGGRDGSWATAPPWRGIRAESAWVARVSAPRGASSFLSPRFRPGWGEALLHHSGFPERGWPAGETEARDPDRRLHCAGRSAVTDVVEPPRVFL

SEQ ID NO: 756579 - protein, 171 aa, Homo sapiens [sequence omitted]

SEQ ID NO: 756580 - protein, 171 aa, Homo sapiens [sequence omitted]

SEQ ID NO: 756581 - protein, 221 aa, Homo sapiens
TLEDPCSAQRLVSSNFITHQRTHTGVKPYRCNDCGESFSQSSDLIKHQRTHTGERPFKCPECGKGFRDSSHFVAHMSTHSGERPFSCPDCHKSFSQSSHLVTHQRTHTGERPFKCENCGKGFADSSALIKHQRIHTGERPYKCGECGKSFNQSSHFITHQRIHLGDRPYRCPECGKTFNQRSHFLTHQRTHTGEKPFHCSKCNKSFRQKAHLLCHQNTHLI

SEQ ID NO: 756582 - protein, 221 aa, Homo sapiens; identical to SEQ ID NO: 756581

SEQ ID NO: 756583 - protein, 128 aa, Homo sapiens
MFHSPGFILSEVEARRPQYPLPGMLGTVDWMTVSFSVCVCVCVFFFFFFEAGRNCTEKRPILQIWRPRSRGTRALPSTAPLMGESVGLMLRSFGLSFCLFIATPGGEGPSGLTLGSDLSAVSKVCLSL

SEQ ID NO: 756584 - protein, 103 aa, Homo sapiens
KFCFCHRAVTESINQLITLCTQQAPGQKECDNALRELETVKGMLDNPNEPVSDLSYFDCIESVMENSKVLGESMAGISQNAKTGDLPAFGECVGIASKALCGL

SEQ ID NO: 756585 - protein, 126 aa, Homo sapiens
ENSTIQESAAIQQAHVKLKEHLNHNPSPSSVVFVQEGPPFSTHQVDANIKCQTSSRENILPSEQMGFLISEMGPASKPSEDTGLATPARYREHRSNSQQGKSPDLHLLVDVGCKQERFPKEEELKE

SEQ ID NO: 756586 - protein, 152 aa, Homo sapiens
SAPNTEGVKSSSVMPSPSTTLARQGSLESPSSGTGSMGSAGGLSGSSSPLFNKPSDLTTDVISLSHSLASSPASVHSFTSGGLVWAANMSSSSAGSKDTPSYQSMTSLHTSSESIDLPLSHHGSLSGLTTGTHEVQSLLMRTGSVRSTLSER

SEQ ID NO: 756587 - protein, 1817 aa, Homo sapiens
QSGDDEEYQRIYTTKIKPRLKSEDGVEGDLGETQSRTITVTRRVTAYTVDVTGREGAKDIDISSPEFKIKIPRHELTEISNVDVETQSGKTVIRLPSGSGAASPTGSAVDIRAGAISASGPELQGAGHSKLQVTMPGIKVGGSGVNVNAKGLDLGGRGGVQVPAVDISSSLGGRAVEVQGPSLESGDHGKIKFPTMKVPKFGVSTGREGQTPKAGLRVSAPEVSVGHKGGKPGLTIQAPQLEVSVPSANIEGLEGKLKGPQITGPSLEGDLGLKGAKPQGHIGVDASAPQIGGSITGPSVEVQAPDIDVQGPGSKLNVPKMKVPKFSVSGAKGEETGIDVTLPTGEVTVPGVSGDVSLPEIATGGLEGKMKGTKVKTPEMIIQKPKISMQDVDLSLGSPKLKGDIKVSAPGVQGDVKGPQVALKGSRVDIETPNLEGTLTGPRLGSPSGKTGTCRISMSEVDLNVAAPKVKGGVDVTLPRVEGKVKVPEVDVRGPKVDVSAPDVEAHGPEWNLKMPKMKMPTFSTPGAKGEGPDVHMTLPKGDISISGPKVNVEAPDVNLEGLGGKLKGPDVKLPDMSVKTPKISMPDVDLHVKGTKVKGEYDVTVPKLEGELKGPKVDIDAPDVDVHGPDWHLKMPKMKMPKFSVPGFKAEGPEVDVNLPKADVDISGPKIDVTAPDVSIEEPEGKLKGPKFKMPEMNIKVPKISMPDVDLHLKGPNVKGEYDVTMPKVESEIKVPDVELKSAKMDIDVPDVEVQGPDWHLKMPKMKMPKFSMPGFKAEGPEVDVNLPKADVDISGPKVGVEVPDVNIEGPEGKLKGPKFKMPEMNIKAPKISMPDVDLHMKGPKVKGEYDMTVPKLEGDLKGPKVDVSAPDVEMQGPDWNLKMPKIKMPKFSMPSLKGEGPEFDVNLSKANVDISAPKVDTNAPDLSLEGPEGKLKGPKFKMPEMHFRAPKMSLPDVDLDLKGPKMKGNVDISAPKIEGEMQVPDVDIRGPKVDIKAPDVEGQGLDWSLKIPKMKMPKFSMPSLKGEGPEVDVNLPKADVVVSGPKVDIEAPDVSLEGPEGKLKGPKFKMPEMHFKTPKISMPDVDLHLKGPKVKGDVDVSVPKVEGEMKVPDVEIKGPKMDIDAPDVEVQGPDWHLKMPKMKMPKFSMPGFKGEGREVDVNLPKADIDVSGPKVDVEVPDVSLEGPEGKLKGPKFKMPEMHFKAPKISMPDVDLNLKGPKLKGDVDVSLPEVEGEMKVPDVDIKGPKVDISAPDVDVHGPDWHLKMPKVKMPKFSMPGFKGEGPEVDVKLPKADVDVSGPKMDAEVPDVNIEGPDAKLKGPKFKMPEMSIKPQKISIPDVGLHLKGPKMKGDYDVTVPKVEGEIKAPDVDIKGPKVDINAPDVEVHGPDWHLKMPKVKMPKFSMPGFKGEGPEVDMNLPKADLGVSGPKVDIDVPDVNLEAPEGKLKGPKFKMPSMNIQTHKISMPDVGLNLKAPKLKTDVDVSLPKVEGDLKGPEIDVKAPKMDVNVGDIDIEGPEGKLKGPKFKMPEMHFKAPKISMPDVDLHLKGPKVKGDMDVSVPKVEGEMKVPDVDIKGPKVDIDAPDVEVHDPDWHLKMPKMKMPKFSMPGFKAEGPEVDVNLPKADIDVSGPSVDTDAPDLDIEGPEGKLKGSKFKMPKLNIKAPKVSMPDVDLNLKGPKLKGEIDASVPELEGDLRGPQVDVKGPFVEAEVPDVDLECPDAKLKGPKFKMPEMHFKAPKISMPDVDLHLKGPKVKGDADVSVPKLEGDLTGPSVGVEVPDVELECPDAKLKGPKFKMPDMHFKAPKISMPDVDLH

SEQ ID NO: 756588 - protein, 68 aa, Homo sapiens
QRLSIDNSKKGESQLRVRDSLRPDHGLYMIKVENDHGIAKAPCTVSVLDTPGPPINFVFEDIRKTSVL

SEQ ID NO: 756589 - protein, 1678 aa, Homo sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 756590 - protein, 1691 aa, Homo sapiens
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 756591 - protein, 73 aa, Homo sapiens [sequence omitted]

SEQ ID NO: 756592 - protein, 202 aa, Homo sapiens
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPVCCQIFAFYFKWLCLSLRVPFFCLSGNLKILWGSHYTPLSNVGVNTGSTTTVKV

SEQ ID NO: 756593 - protein, 430 aa, Homo sapiens
MATAVRAVGCLPVLCSGTAGHLLGRQCSLNTLPAASILAWKSVLGNGHLSSLGTRDTHPYASLSRALQTQCCISSPSHLMSQQYRPYSFFTKLTADELWKGALAETGAGAKKGRGKRTKKKKRKDLNRGQIIGEGRYGFLWPGLNVPLMKNGAVQTIAQRSKEEQEKVEADMIQQREEWDRKKKMKVKRERGWSGNSWGGISLGPPDPGPCGETYEDFDTRILEVRNVFTMTAKEGRKKSIRVLVAVGNGKGAAGFSIGKATDRMDAFRKAKNRAVHHLHYIERYEDHTIFHDISLRFKRTHIKMKKQPKGYGLRCHRAIITICRLIGIKDMYAKVSGSINMLSLTQGLFRGLSRQETHQQLADKKGLHVVEIREECGPLPIVVASPRGPLRKDPEPEDEVPDVKLDWEDVKTAQGMKRSVWSNLKRAAT

SEQ ID NO: 756594 - protein, 422 aa, Homo sapiens
SSFASSFFCSSSHLLGRQCSLNTLPAASILAWKSVLGNGHLSSLGTRDTHPYASLSRALQTQCCISSPSHLMSQQYRPYSFFTKLTADELWKGALAETGAGAKKGRGKRTKKKKRKDLNRGQIIGEGRYGFLWPGLNVPLMKNGAVQTIAQRSKEEQEKVEADMIQQREEWDRKKKMKVKRERGWSGNSWGGISLGPPDPGPCGETYEDFDTRILEVRNVFTMTAKEGRKKSIRVLVAVGNGKGAAGFSIGKATDRMDAFRKAKNRAVHHLHYIERYEDHTIFHDISLRFKRTHIKMKKQPKGYGLRCHRAIITICRLIGIKDMYAKVSGSINMLSLTQGLFRGLSRQETHQQLADKKGLHVVEIREECGPLPIVVASPRGPLRKDPEPEDEVPDVKLDWEDVKTAQGMKRSVWSNLKRAAT

SEQ ID NO: 756595 - protein, 411 aa, Homo sapiens
MATAVRAVGCLPVLCSGTAGHLLGRQCSLNTLPAASILAWKSVLGNGHLSSLGTRDTHPYASLSRALQTQCCISSPSHLMSQQYRPYSFFTKLTADELWKGALAETGAGAKKGRGKRTKKKKRKDLNRGQIIGEGRYGFLWPGLNVPLMKNGAVQTIAQRSKEEQEKVEADMIQQREEWDRKKKMKVKRERGWKTYEDFDTRILEVRNVFTMTAKEGRKKSIRVLVAVGNGKGAAGFSIGKATDRMDAFRKAKNRAVHHLHYIERYEDHTIFHDISLRFKRTHIKMKKQPKGYGLRCHRAIITICRLIGIKDMYAKVSGSINMLSLTQGLFRGLSRQETHQQLADKKGLHVVEIREECGPLPIVVASPRGPLRKDPEPEDEVPDVKLDWEDVKTAQGMKRSVWSNLKRAAT

SEQ ID NO: 756596 - protein, 430 aa, Homo sapiens; identical to SEQ ID NO: 756593

SEQ ID NO: 756597 - protein, 264 aa, Homo sapiens
MARTECPSYEKWSSADHCPKKQGRAGEGGGRHDPAERRVGPKEEDEETYEDFDTRILEVRNVFTMTAKEGRKKSIRVLVAVGNGKGAAGFSIGKATDRMDAFRKAKNRAVHHLHYIERYEDHTIFHDISLRFKRTHIKMKKQPKGYGLRCHRAIITICRLIGIKDMYAKVSGSINMLSLTQGLFRGLSRQETHQQLADKKGLHVVEIREECGPLPIVVASPRGPLRKDPEPEDEVPDVKLDWEDVKTAQGMKRSVWSNLKRAAT

SEQ ID NO: 756598 - protein, 192 aa, Homo sapiens [sequence omitted]

SEQ ID NO: 756599 - protein, 131 aa, Homo sapiens
MSKNERKQTTKGYGLRCHRAIITICRLIGIKDMYAKVSGSINMLSLTQGLFRGLSRQETHQQLADKKGLHVVEIREECGPLPIVVASPRGPLRKDPEPEDEVPDVKLDWEDVKTAQGMKRSVWSNLKRAAT

SEQ ID NO: 756600 - protein, 105 aa, Homo sapiens
TLDIPYRRGEVSGSINMLSLTQGLFRGLSRQETHQQLADKKGLHVVEIREECGPLPIVVASPRGPLRKDPEPEDEVPDVKLDWEDVKTAQGMKRSVWSNLKRAAT

SEQ ID NO: 756601 - protein, 168 aa, Homo sapiens
MATAVRAVGCLPVLCSGTAGHLLGRQCSLNTLPAASILAWKSVLGNGHLSSLGTRDTHPYASLSRALQTQCCISSPSHLMSQQYRPYSFFTKLTADELWKGALAETGAGAKKGRGKRTKKKKRKDLNRGQIIGEGRYGFLWPGLNVPLMKNGAVQTIAQRSKEELHRE

SEQ ID NO: 756602 - protein, 430 aa, Homo sapiens; identical to SEQ ID NO: 756593

SEQ ID NO: 756603 - protein, 292 aa, Homo sapiens [sequence omitted]

SEQ ID NO: 756604 - protein, 168 aa, Homo sapiens; identical to SEQ ID NO: 756601

SEQ ID NO: 756605 - protein, 121 aa, Homo sapiens
MGPSASSHGSPVPLPSDLSFRSPTPSNLPMVQLWAAHAHEGFSHLPSGLYPSYLHLNHLEPPSSGSPLLSQLGQPSIFDTQKGQGPGGDGFYLPTAGAPGSLHSHAPSARTLAGHSSGAPA

SEQ ID NO: 756606 - protein, 236 aa, Homo sapiens
EALNGPEALNGPLPSDLSFRSPTPSNLPMVQLWAAHAHEGFSHLPSGLYPSYLHLNHLEPPSSGSPLLSQLGQPSIFDTQKGQGPGGDGFYLPTAGAPGSLHSHAPSARTLAQMAVLAAQHHHSRAEEEAAVVAASSSKKAYLDPGAVLPRSAATCGRPVADMHSAAHGPGEASAMQSLIKYSGSFARDAVAVRPGGCGKKSPFGGLGTMKPEPAPTSAGASRAQARLPHSGGPAA

SEQ ID NO: 756607 - protein, 208 aa, Homo sapiens
RPPPADAPTVRATRASPDPRAYVPAKELLKPEADPRPCERAPRGPAGPAAQQAAKLFGLEPGRPPPTGPEHKWKPFELGNFAATQMAVLAAQHHHSRAEEEAAVVAASSSKKAYLDPGAVLPRSAATCGRPVADMHSAAHGPGEASAMQSLIKYSGSFARDAVAVRPGGCGKKSPFGGLGTMKPEPAPTSAGASRAQARLPHSGGPAA

SEQ ID NO: 756608 - protein, 62 aa, Homo sapiens
EALNGPEALNGPLPSDLSFRSPTPSNLPMVQLWAAHAHEGKEHAGVGAEGCWADVPATLATS

SEQ ID NO: 756609 - protein, 371 aa, Homo sapiens
MGHKVVVFDISVIRALWETRVKKHKAWQKKEVERLEKSALEKIKEEWNFVAECRRKGIPQAVYCKNGFIDTSVRLLDKIERNTLTRQSSLPKDRGKRSSAFVFELSGEHWTELPDSLKEQTHLREWYISNTLIQIIPTYIQLFQEMRILDLPKNQISHLPAEIGCLKNLKELNVGFNYLKSIPPELGDCENLERLDCSGNLELMELPFELSNLKQVTFVDISANKFSSVPICVLRMSNLQWLDISSNNLTDLPQDIDRLEELQSFLLYKNKLTYLPYSMLNLKKLTLLVVSGDHLVELPTALCDSSTPLKFVSLMDNPIDNAQCEDGNEIMESERDRQHFDKEVMKAYIEDLKERESVPSYTTKVSFSLQL

SEQ ID NO: 756610 - protein, 371 aa, Homo sapiens; identical to SEQ ID NO: 756609

SEQ ID NO: 756611 - protein, 409 aa, Homo sapiens
MSLLAHRHGRLLPARPCCSAGVNSLCGVNSLCGVNSRGGQARTVSARPSGQVALWETRVKKHKAWQKKEVERLEKSALEKIKEEWNFVAECRRKGIPQAVYCKNGFIDTSVRLLDKIERNTLTRQSSLPKDRGKRSSAFVFELSGEHWTELPDSLKEQTHLREWYISNTLIQIIPTYIQLFQEMRILDLPKNQISHLPAEIGCLKNLKELNVGFNYLKSIPPELGDCENLERLDCSGNLELMELPFELSNLKQVTFVDISANKFSSVPICVLRMSNLQWLDISSNNLTDLPQDIDRLEELQSFLLYKNKLTYLPYSMLNLKKLTLLVVSGDHLVELPTALCDSSTPLKFVSLMDNPIDNAQCEDGNEIMESERDRQHFDKEVMKAYIEDLKERESVPSYTTKVSFSLQL

SEQ ID NO: 756612 - protein, 371 aa, Homo sapiens; identical to SEQ ID NO: 756609

SEQ ID NO: 756613 - protein, 371 aa, Homo sapiens; identical to SEQ ID NO: 756609

SEQ ID NO: 756614 - protein, 282 aa, Homo sapiens
MRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 756615 - protein, 282 aa, Homo sapiens; identical to SEQ ID NO: 756614

SEQ ID NO: 756616 - protein, 566 aa, Homo sapiens
MFAVVFFILSLMTCQPGVTAQEKVNQRVRRAATPAAVTCQLSNWSEWTDCFPCQDKSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 756617 - protein, 274 aa, Homo sapiens
MRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCHACEQTQTEGAKADGSWSCWSSWSVCRAGIQERRRECDNPAPQNGGASCPGRKVQTQAC

SEQ ID NO: 756618 - protein, 583 aa, Homo sapiens
MFAVVFFILSLMTCQPGVTAQEKVNQRVRRAATPAAVTCQLSNWSEWTDCFPCQDKYRHRSLLQPNKFGGTICSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 756619 - protein, 520 aa, Homo sapiens
MPNKFGGTICSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 756620 - protein, 282 aa, Homo sapiens; identical to SEQ ID NO: 756614

SEQ ID NO: 756621 - protein, 119 aa, Homo sapiens
MRKDDIMLDEGMLQSLMELPDQYNYGMYAKFINDYGTHYITSGSMGGIYEYILVIDKDAAYPRGAAAHKPGASGGQAPEPAPRLGPVSDGIQCLPMWALLQQWGAHPRGHQLQVPVPPG

SEQ ID NO: 756622 - protein, 805 aa, Homo sapiens [sequence omitted]

SEQ ID NO: 756623 - protein, 805 aa, Homo sapiens [sequence omitted]

SEQ ID NO: 756624 - protein, 772 aa, Homo sapiens
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSIWLIVFGVVMGVIVVGIVILIFTGIRDRKKKNKARSGENPYASIDISKGENNPGFQNTDDVQTSF

SEQ ID NO: 756625 - protein, 194 aa, Homo sapiens
MFFLTITSSHCLPSPMSLYPVILSLISFSPAGEVFILLIVSSVPQVKMFVLFLYREEDVRVANLKPRISFNFFVTAPKNVSDIIPRTEVEKAIRMSRSRINDAFRLNDNSLEFLGIQPTLGPPNQPPVSIWLIVFGVVMGVIVVGIVILIFTGIRDRKKKNKARSGENPYASIDISKGENNPGFQNTDDVQTSF

SEQ ID NO: 756626 - protein, 441 aa, Homo sapiens
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNGNSNCMFTL

SEQ ID NO: 756627 - protein, 118 aa, Homo sapiens
MCSRSLWFFQMRKAGESMGTTSKPCLEICAGRGGFCLLEEGRGVGVRSQEENSVPLGQVTDSHESAEHHGLRLVVKKEPRFTISSHLVFCIKNTLSLGMCVCMLYTHMYIYMYIFFLN

SEQ ID NO: 756628 - protein, 155 aa, Homo sapiens
LVNYQISVKCSNQFKLEGVSLNAENKVVDNQAGTQGQLKVLGANLWWPYLMHEHPAYLYSWEEVIAHTKALDPSQPVTFVTNSTYAADKGALYVDVIRVNSYYSWYRNYGHLELIQLQLAAQFENWCKTSQSHYSERVWSGNACRVSPGSTSDVQ

SEQ ID NO: 756629 - protein, 95 aa, Homo sapiens
PSEDRYFGHHQVDLYFYLTFTILPVLTLNSLCLESQDPPLMFSEEDRKSLLEQYHLGLDQKRRKYVVGELIWNFADFMTNQCVSFLVGNENSANL

SEQ ID NO: 756630 - protein, 567 aa, Homo sapiens
HPIWGKDRSWTGQELSPLAGEDREKGSTGARKEEEGGPVLVKEKLGLKKLVLTQEQKTMLLDWNDSIPESVHLKAGERISQKSAENGRGGRVLKPVRPLLLPRAAGEPLPTQRGAQEKMGTPAEQAQGERNVPPPKSPLRLIANAIRRSLEPLLSNSEGGKKAWAKQESKTLPTQACTRSFSLRKTNSNKDGDQHSPGRNQSSAFSPPDPALRTHSLPNRPSKVFPALRSPPCSKIEEVPTLLEKVSLQENFPDASKPPKKRISLFSSLRLKDKSFESFLQESRQRKDIRDLFGSPKRKVLPEDSAQALEKLLQPFKSTSLRQAAPPPPPPPPPPPPPPPPPTAGGADSKNFPLRAQVTEASSSASSTSSSSADEEFDPQLSLQLKEKKTLRRRKKLEKAMKQLVKQEELKRLYKAQAIQRQLEEVEERQRASEIQGVRLEKALRGEADSGTQDEAQLLQEWFKLVLEKNKLMRYESELLIMAQELELEDHQSRLEQKLREKMLKEESQKDEKDLNEEQEVFTELMQVIEQRDKLVDSLEEQRIREKAEDQHFESFVFSRGCQLSRT

SEQ ID NO: 756631 - protein, 212 aa, Homo sapiens
YLTSAGGPLRTRVEIHRRQSRNDPPHDDRAANGNIRALPEEPGSENVPAKSQRSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKMIGFPSSAGSVSPRSTSVTTTSSASVTTTSNASGRRTSDVRRP

SEQ ID NO: 756632 - protein, 126 aa, Homo sapiens
LPTTAFDGLCDGVTHTVPIYEGPSPMPPCEPMSEVRSIEAQLSELRSEMECQNQEYKMLLDIKTRLEQEIATYRSLLEGQDAKMIGFPSSAGSVSPRSTSVTTTSSASVTTTSNASGRRTSDVRRP

SEQ ID NO: 756633 - protein, 458 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAVDDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHAKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKMIGFPSSAGSVSPRSTSVTTTSSASVTTTSNASGRRTSDVRRP

SEQ ID NO: 756634 - protein, 458 aa, Homo sapiens; identical to SEQ ID NO: 756633

SEQ ID NO: 756635 - protein, 420 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAVDDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHAKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKKRQPP

SEQ ID NO: 756636 - protein, 458 aa, Homo sapiens; identical to SEQ ID NO: 756633

SEQ ID NO: 756637 - protein, 378 aa, Homo sapiens
PPSDPRIFTPIAGCCDGGLLTGNEKITMQNLNDRLASYLEKVRALEEANADLEVKIRDWHLKQSPASPERDYSPYYKTIEELRDKILTATIENNRVILEIDNARLAVDDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHAKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKMIGFPSSAGSVSPRSTSVTTTSSASVTTTSNASGRRTSDVRRP

SEQ ID NO: 756638 - protein, 212 aa, Homo sapiens [sequence omitted]

SEQ ID NO: 756639 - protein, 189 aa, Homo sapiens
MSLRLQKMREQYEAMAERNRRDAEEWFHAKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKMIGFPSSAGSVSPRSTSVTTTSSASVTTTSNASGRRTSDVRRP

SEQ ID NO: 756640 - protein, 169 aa, Homo sapiens
PPPSSCLHFRSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKMIGFPSSAGSVSPRSTSVTTTSSASVTTTSNASGRRTSDVRRP

SEQ ID NO: 756641 - protein, 415 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAVDDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHAKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAK

SEQ ID NO: 756642 - protein, 458 aa, Homo sapiens; identical to SEQ ID NO: 756633

SEQ ID NO: 756643 - protein, 415 aa, Homo sapiens; identical to SEQ ID NO: 756641

SEQ ID NO: 756644 - protein, 420 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAVDDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHAKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQERGGAAGPKAQSLCSQDPLS

SEQ ID NO: 756645 - protein, 170 aa, Homo sapiens
QCWALQCREGESWGGSGHSLTDFPFETDGSAPQSYLAVLGRAIFGDNKESPSTHHLTNEEFVSPPGGPCPVLRWVFSSLSMSCLLFPREASAPVAPLLPRLLVPLLPPPLMPLVAALLMSVGLKSAWRPLPLSSAPRGGESRQFPAGERRGCWTQGSVPLLSGPPVLTLS

SEQ ID NO: 756646 - protein, 183 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIVNNRALSICRSN

SEQ ID NO: 756647 - protein, 182 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQNHEEEMNALRGQVGGDVNVEMDAAPGVDLSRILNEMRDR

SEQ ID NO: 756648 - protein, 79 aa, Homo sapiens
GSSTVRRKYKMLLDIKTRLEQEIATYRSLLEGQDAKMIGFPSSAGSVSPRSTSVTTTSSASVTTTSNASGRRTSDVRRP

SEQ ID NO: 756649 - protein, 161 aa, Homo sapiens
ERELQAALGSTTSSEKEEPSPATGHSPPLWDLETLSRTLCQHSEPRRGRMSSLTHLPFPSPQEMKEFSNQVVGQVNVEMDATPGIDLTRVLAEMREQYEAMAERNRRDAEEWFHAKVPGPPTPHSPSHIARGAGRTQPLGQAARAELPHHLLPACISEVQS

SEQ ID NO: 756650 - protein, 169 aa, Homo sapiens; identical to SEQ ID NO: 756640

SEQ ID NO: 756651 - protein, 458 aa, Homo sapiens; identical to SEQ ID NO: 756633

SEQ ID NO: 756652 - protein, 458 aa, Homo sapiens; identical to SEQ ID NO: 756633

SEQ ID NO: 756653 - protein, 458 aa, Homo sapiens; identical to SEQ ID NO: 756633

SEQ ID NO: 756654 - protein, 415 aa, Homo sapiens; identical to SEQ ID NO: 756641

SEQ ID NO: 756655 - protein, 415 aa, Homo sapiens; identical to SEQ ID NO: 756641

SEQ ID NO: 756656 - protein, 458 aa, Homo sapiens; identical to SEQ ID NO: 756633

SEQ ID NO: 756657 - protein, 381 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAVDDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHAKEASAPVAPLLPRLLVPLLPPPLMPLVAALLMSVGLKSAWRPLPLSSAPRGGESRQFPAGERRGCWTQGSVPLLSGPPVLTLS

SEQ ID NO: 756658 - protein, 79 aa, Homo sapiens; identical to SEQ ID NO: 756648

SEQ ID NO: 756659 - protein, 274 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAVDDFRLKYENELALRQSVEADINGLRRVLDELTLSKTDLEMQIESLNEELAYMKKNHEEEERAGSSLQERGGAAGPKAQSLCSQDPLS

SEQ ID NO: 756660 - protein, 224 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKNPWNRANPLEKQTWVPFRGRFANCQGCVWVDRTSGLKVMRKWEAWPLWGQEAWGGPEST

SEQ ID NO: 756661 - protein, 173 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKTTGVLYSS

SEQ ID NO: 756662 - protein, 59 aa, Homo sapiens
MSLRLQSSSASYGGGFGGGSCQLGGGRGVSTCSTRFVSGGSAGGPPAKTPRRGACRGWG

SEQ ID NO: 756663 - protein, 69 aa, Homo sapiens
ERRREERGEREKEREEEQEREACLAYYRIFFSPLKTSSLHIWLTAWYTWLVSGFCLNSVIEETNLQEPL

SEQ ID NO: 756664 - protein, 97 aa, Homo sapiens
WGAVLTQGGDIHGRCGNDADPHTKCSRGFEWVTYATVEVEDAAMNAEATQGEQKTCDLDMMAWRRETLMMLQRHPWAESFFFGDRISLCHPGWSAVA

SEQ ID NO: 756665 - protein, 317 aa, Homo sapiens
MAKNPPENCEDCHILNAEAFKSKKICKSLKICGLVFGILALTLIVLFWGSKHFWPEVPKKAYDMEHTFYSNGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 756666 - protein, 56 aa, Homo sapiens
VWTSLRGPEQEAGSQAEWPMRPPKFQEQPVIWKLWKLLKTRSNDLGWTKDSRSLLC

SEQ ID NO: 756667 - protein, 180 aa, Homo sapiens
FPPLFSPLSSESASSSSHLPLPSLSLPLGSLFLPSLWFLCLCPVLSFPSSLDLSPLLALSPSSSHSHWPPSREPRLLRLQVAPASLPGGPLPPSPVPALPAPRFPGPDQEAGVHTEGPNRLALSRAPKPEAQEWTDLCDTHSLFLFHLSGTLDTAWRNQACRRPRKAETKTTLRDRKQLA

SEQ ID NO: 756668 - protein, 180 aa, Homo sapiens; identical to SEQ ID NO: 756667

SEQ ID NO: 756669 - protein, 315 aa, Homo sapiens
TNNKEQGVVIDSLKLSEEMKPNLDGVDLFNNGGSGNGETKTGLRLKAINLPLENEVTEISALQVHLDEFQKILWKEREMRTALEKEIERLESALSLWKWKYEELKESKPKNVKEFDILLGQHNDEMQELSGNIKEESKSQNSKDRVICELRAELERLQAENTSEWDKREILEREKQGLERENRRLKIQVKEMEELLDKKNRLSANSQSPDFKMSQIDLQEKNQELLNLQHAYYKLNRQYQANIAELTHANNRVDQNEAEVKKLRLRVEELKQGLNQKEDELDDSLNQIRKLQRSLDEEKERNENLETELRHLQNW

SEQ ID NO: 756670 - protein, 258 aa, Homo sapiens
TNNKEQGVVIDSLKLSEEMKPNLDGVDLFNNGGSGNGETKTGLRLKAINLPLENEVTEISALQVHLDEFQKILWKEREMRTALEKEIERLESALSLWKWKYEELKESKPKNVKEFDILLGQHNDEMQELSGNIKEESKSQNSKDRVICELRAELERLQAENTSEWDKREILEREKQGLERENRRLKIQVKEMEELLDKKNRLSANSQSPDFKMSQIDLQEKNQLDDSLNQIRKLQRSLDEEKERNENLETELRHLQNW

SEQ ID NO: 756671 - protein, 258 aa, Homo sapiens; identical to SEQ ID NO: 756670

SEQ ID NO: 756672 - protein, 238 aa, Homo sapiens
TNNKEQGVVIDSLKLSEEMKPNLDGVDLFNNGGSGNGETKTGLRLKAINLPLENEVTEISALQVHLDEFQKILWKEREMRTALEKEIERLESALSLWKWKYEELKESKPKNVKEFDILLGQHNDEMQELSGNIKEESKSQNSKDRVICELRAELERLQAENTSEWDKREILEREKQGLERENRRLKIQVKEMEELLDKKNRLSANSQSPDFKMSQIDLQEKNQVWVLLGANSHCLISL

SEQ ID NO: 756673 - protein, 209 aa, Homo sapiens
MRGSGRLRTPELCCSRPPPPGPGRPWLPSCLEKGRASQRLGGKKNGGRDRAEYKSRFSGLYLTRCSNSSERQRERAGGRLGWKSRASRAALRASWEGRSGANRGLRLWPSPPADPPASGPQPLPHPRNFAHSSGRALCTGTYNTRARTRLSRRGEAILPIWGHFPAAARTRFSERLSLQLLRRWIFFRVVENQQPPATIALQLSFTTGT

SEQ ID NO: 756674 - protein, 450 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAASNYARGHYTIGKEIVDLVLDRIRKLADLCTGLQGFLIFHSFGGGTGSGFASLLMERLSVDYSKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLVHKFDLMYAKWAFVHWYVGEGMEEGEFSEAREDLAALEKDCEEVGVDSVEAEAEEGEEY

SEQ ID NO: 756675 - protein, 466 aa, Homo sapiens
RVEGTRAVTDRDYDYPRVICLSACVIGPWSYIGNACWELYCLEHGIQPDGQMPSDKTIGGGDDSFNTFFSETGAGKHVPRAVFVDLEPTVVDEVRTGTYRQLFHPEQLITGKEDAASNYARGHYTIGKEIVDLVLDRIRKLADLCTGLQGFLIFHSFGGGTGSGFASLLMERLSVDYSKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLVHKFDLMYAKWAFVHWYVGEGMEEGEFSEAREDLAALEKDCEEVGVDSVEAEAEEGEEY

SEQ ID NO: 756676 - protein, 906 aa, Homo sapiens
MAGNVKKSSGAGGGTGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 756677 - protein, 445 aa, Homo sapiens
RSQRWFMRVTLVAQQPWSKWHAIYSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 756678 - protein, 844 aa, Homo sapiens
MAGNVKKSSGAGGGTGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQVS

SEQ ID NO: 756679 - protein, 258 aa, Homo sapiens [sequence omitted]

SEQ ID NO: 756680 - protein, 345 aa, Homo sapiens
MAGNVKKSSGAGGGTGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGSKT

SEQ ID NO: 756681 - protein, 103 aa, Homo sapiens
KYIQCLPAIYLFIFLMFVSLLVAHLYIDTAFRIWVSWLHCCICAPLSLLNVLYQGRSQQHLLVLSNLSLWSSLFPVWGLLHCHLVVVVVVAVMYLCLLLSVPA

SEQ ID NO: 756682 - protein, 129 aa, Homo sapiens
RTCNRFRLLLERRTVGSEVTSGADCPGSQVWLVPGGGRGVQPRARGDVVGGGQERESRAEFLGWGEAVWRFVSHLTQPGTFLSQQRSVTCAPHVRLPLSSVLASSALSQHSLSLCSNPAHLMAFFAPPA

SEQ ID NO: 756683 - protein, 210 aa, Homo sapiens
MAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKVTRPSQAWVASGPPIWPAFMRLLFVKHPLGPGLEQKC

SEQ ID NO: 756684 - protein, 621 aa, Homo sapiens
MSGCGLFLRTTAAARACRGLVVSTANRRLLRTSPPVRAFAKELFLGKIKKKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 756685 - protein, 678 aa, Homo sapiens
AGWYRPEWLGSAALSKKGRLRLRLGNIGQHERLRALPAHHGCGSCLPGSGGLYREPAATAHQPACTSFRQRAFPRQNQEGNASPGRTLAVWLPLFTLSCKTGVELCEIPQTCQRDTPCGRGVLTLRIPEFQENLPREKVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 756686 - protein, 709 aa, Homo sapiens
AGWYRPEWLGSAALSKKGRLRLRLGNIGQHERLRALPAHHGCGSCLPGSGGLYREPAATAHQPACTSFRQRAFPRQNQEGNASPGRTLAVWLPLFTLSCKTGVELCEIPQTCQRDTPCGRGVLTLRIPEFQENLPRERKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 756687 - protein, 621 aa, Homo sapiens; identical to SEQ ID NO: 756684

SEQ ID NO: 756688 - protein, 646 aa, Homo sapiens
MSGCGLFLRTTAAARACRGLVVSTANRRLLRTSPPVRAFAKELFLGKIKKKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKGPALSPRLECRARSWLTAASTSWAQVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 756689 - protein, 558 aa, Homo sapiens
MSGCGLFLRTTAAARACRGLVVSTANRRLLRTSPPVRAFAKELFLGKIKKKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKVTRPSQAWVASGPPIWPAFMRLLFVKHPLGPGLEQKC

SEQ ID NO: 756690 - protein, 325 aa, Homo sapiens [sequence omitted]

SEQ ID NO: 756691 - protein, 548 aa, Homo sapiens
MSGCGLFLRTTAAARACRGLVVSTANRRLLRTSPPVRAFAKELFLGKIKKKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLATVPQVEGTPTASADVGPAGRWQTLGGVLGGAILHVVGGGGRPCPPLPWWSPVT

SEQ ID NO: 756692 - protein, 468 aa, Homo sapiens
AGWYRPEWLGSAALSKKGRLRLRLGNIGQHERLRALPAHHGCGSCLPGSGGLYREPAATAHQPACTSFRQRAFPRQNQEGNASPGRTLAVWLPLFTLSCKTGVELCEIPQTCQRDTPCGRGVLTLRIPEFQENLPREKVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNIPPQSRRIHALGRGPMSMALIKTNDRTELLTTPAPRKQITRRLSAKIGTWTPRTHNWAPALSLTTRISGHRTANDPTSPLGDFCPKLDIPPLFTRTTHCQMVVSTRTPVLVRN

SEQ ID NO: 756693 - protein, 621 aa, Homo sapiens; identical to SEQ ID NO: 756684

SEQ ID NO: 756694 - protein, 621 aa, Homo sapiens; identical to SEQ ID NO: 756684

SEQ ID NO: 756695 - protein, 645 aa, Homo sapiens
RGPVTSSDVCVPAALRSKKGRLRLRLGNIGQHERLRALPAHHGCGSCLPGSGGLYREPAATAHQPACTSFRQRAFPRQNQEEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 756696 - protein, 621 aa, Homo sapiens; identical to SEQ ID NO: 756684

SEQ ID NO: 756697 - protein, 415 aa, Homo sapiens
MASTRLGLNGRGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 756698 - protein, 655 aa, Homo sapiens
MSGCGLFLRTTAAARACRGLVVSTANRRLLRTSPPVRAFAKELFLGKIKKKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKGPALSPRLECRARSWLTAASTSWAQVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQFLVFFLNIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 756699 - protein, 316 aa, Homo sapiens
LRQHTSSVKVCQNDEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 756700 - protein, 277 aa, Homo sapiens
MGTPINRGCEARLHLCVKLALGGNQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 756701 - protein, 112 aa, Homo sapiens
GPWTFCSELKQAKVSTVMDTVGRRLRDSLGRTVDLGLTGNHGVVHPSLADSANKFEENTYCFGRTVETLLLRFGKVTRPSQAWVASGPPIWPAFMRLLFVKHPLGPGLEQKC

SEQ ID NO: 756702 - protein, 83 aa, Homo sapiens
TAAARACRGLVVSTANRRLLRTSPPVRAFAKELFLGKIKKVTRALGEPLLSGSRFSPSAARLVLNFVRFPKPAREIHPAAEAC

SEQ ID NO: 756703 - protein, 239 aa, Homo sapiens
MEGTVESQTPDLRDVEGKVGRKTPEGLLRGLRGECELGTSGALLLPGASSTGHDLGDKIMALKMELAYLRAIDVKILQQLVTLNEGIEAVRWLLEERGTLTSHCSSLTSSQYSLTGGSPGRSRRGSWDSLPDTSTTDRLDSVSIGSFLDTVAPSELDEQGPPGAPRSEMDWAKVIAGGERARTEVDVAATRLGSLRAVWKPPGERLQGGPPESPEDESAKLGFEAHWFWEQCQDDVTFL

SEQ ID NO: 756704 - protein, 249 aa, Homo sapiens
MEGTVESQTPDLRDVEGKVGRKTPEGLLRGLRGECELGTSGALLLPGASSTGHDLGDKIMALKMELAYLRAIDVKILQQLVTLNEGIEAVRWLLEERGTLTSHCSSLTSSQYSLTGGSPGRSRRGSWDSLPDTSTTDRLDSVSIGSFLDTVAPSELDEQGPPGAPRSEMDWAKVIAGGERARTEVDVAATRLGSLRAVWKPPGERLQGGPPESPEDESAKLGFEAHWFWEQCQDDVTFLSLCQTQAQDG

SEQ ID NO: 756705 - protein, 59 aa, Homo sapiens
GNEMGFMIGALTDRMVYKKSGGEESECFLPAELLHSRQGPARPVFAEGGQASFACLKGT

SEQ ID NO: 756706 - protein, 136 aa, Homo sapiens
FFLRQGLALSPRLEFSGPSIAHCSLDLLGFKVILLPQPAKQLGLFADGIKKQGICVSLWKNPGSSGTVGSLCCCHVIKKLEVAEPNPYTQNTSQGHLSLLHLAMTPKEKSKWSLHAKQVANHHRFCLSNYQIYVYI

SEQ ID NO: 756707 - protein, 317 aa, Homo sapiens
MGYDVTRFQGDVDEDLICPICSGVLEEPVQAPHCEHAFCNACITQWFSQQQTCPVDRSVVTVAHLRPVPRIMRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGMISTPDAVLQAVIKRSLVESGCPASIVNELIENAHERSWPQGLATLETRQMNRRYYENYVAKRIPGKQAVVVMACENQHMGDDMVQEPGLVMIFAHGVEEI

SEQ ID NO: 756708 - protein, 317 aa, Homo sapiens; identical to SEQ ID NO: 756707

SEQ ID NO: 756709 - protein, 317 aa, Homo sapiens; identical to SEQ ID NO: 756707

SEQ ID NO: 756710 - protein, 317 aa, Homo sapiens; identical to SEQ ID NO: 756707

SEQ ID NO: 756711 - protein, 317 aa, Homo sapiens; identical to SEQ ID NO: 756707

SEQ ID NO: 756712 - protein, 246 aa, Homo sapiens
MRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGMISTPDAVLQAVIKRSLVESGCPASIVNELIENAHERSWPQGLATLETRQMNRRYYENYVAKRIPGKQAVVVMACENQHMGDDMVQEPGLVMIFAHGVEEI

SEQ ID NO: 756713 - protein, 317 aa, Homo sapiens; identical to SEQ ID NO: 756707

SEQ ID NO: 756714 - protein, 317 aa, Homo sapiens; identical to SEQ ID NO: 756707

SEQ ID NO: 756715 - protein, 317 aa, Homo sapiens; identical to SEQ ID NO: 756707

SEQ ID NO: 756716 - protein, 317 aa, Homo sapiens; identical to SEQ ID NO: 756707

SEQ ID NO: 756717 - protein, 121 aa, Homo sapiens
MGYDVTRFQGDVDEDLICPICSGVLEEPVQAPHCEHAFCNACITQWFSQQQTCPVDRSVVTVAHLRPVPRIMRNMLSKLQIACDNAVFGCSAVVRLDNLMSHLSDCEHNPKRPVTCEQGCG

SEQ ID NO: 756718 - protein, 796 aa, Homo sapiens
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNFLGLSAMKLQKLDLLPIAHLHLSYILLDLRNYYIKENETESLQILNAKTLHLVFHPTSLFAIQVNISVNTLGCLQLTNIKLNDDNCQVFIKFLSELTRGPTLLNFTLNHIETTWKCLVRVFQFLWPKPVEYLNIYNLTIIESIREEDFTYSKTTLKALTIEHITNQVFLFSQTALYTVFSEMNIMMLTISDTPFIHMLCPHAPSTFKFLNFTQNVFTDSIFEKCSTLVKLETLILQKNGLKDLFKVGLMTKDMPSLEILDVSWNSLESGRHKENCTWVESIVVLNLSSNMLTDSVFRCLPPRIKVLDLHSNKIKSVPKQVVKLEALQELNVAFNSLTDLPGCGSFSSLSVLIIDHNSVSHPSADFFQSCQKMRSIKAGDNPFQCTCELREFVKNIDQVSSEVLEGWPDSYKCDYPESYRGSPLKDFHMSELSCNITLLIVTIGATMLVLAVTVTSLCIYLDLPWYLRMVCQWTQTRRRARNIPLEELQRNLQFHAFISYSEHDSAWVKSELVPYLEKEDIQICLHERNFVPGKSIVENIINCIEKSYKSIFVLSPNFVQSEWCHYELYFAHHNLFHEGSNNLILILLEPIPQNSIPNKYHKLKALMTQRTYLQWPKEKSKRGLFWANIRAAFNMKLTLVTENNDVKS

SEQ ID NO: 756719 - protein, 408 aa, Homo sapiens
YELSKIAEDDYTDEDLCNNWHVSQNSVSYDEKKGDCSWTKSLLSINLSSNMLTDSVFRCLPPRIKVLDLHSNKIKSVPKQVVKLEALQELNVAFNSLTDLPGCGSFSSLSVLIIDHNSVSHPSADFFQSCQKMRSIKAGDNPFQCTCELREFVKNIDQVSSEVLEGWPDSYKCDYPESYRGSPLKDFHMSELSCNITLLIVTIGATMLVLAVTVTSLCIYLDLPWYLRMVCQWTQTRRRARNIPLEELQRNLQFHAFISYSEHDSAWVKSELVPYLEKEDIQICLHERNFVPGKSIVENIINCIEKSYKSIFVLSPNFVQSEWCHYELYFAHHNLFHEGSNNLILILLEPIPQNSIPNKYHKLKALMTQRTYLQWPKEKSKRGLFWANIRAAFNMKLTLVTENNDVKS

SEQ ID NO: 756720 - protein, 377 aa, Homo sapiens
MFNPHALDSPAVIFDNGSGFCKAGLSGEFGPRHMVSSIVGHLKFQAPSAEANQKKYFVGEEALYKQEALQLHSPFERGLITGWDDVERLWKHLFEWELGVKPSDQPLLATEPSLNPRENREKMAEVMFENFGVPAFYLSDQAVLALYASACVTGLVVDSGDAVTCTVPIFEGYSLPHAVTKLHVAGRDITELLMQLLLASGHTFPCQLDKGLVDDIKKKLCYVALEPEKELSRRPEEVLREYKLPDGNIISLGDPLHQAPEALFVPQQLGSQSPGLSNMVSSSITKCDTDIQKILFGEIVLSGGTTLFHGLDDRLLKELEQLASKDTPIKITAPPDRWFSTWIGASIVTSLSSFKQMWVTAADFKEFGTSVVQRRCF

SEQ ID NO: 756721 - protein, 377 aa, Homo sapiens; identical to SEQ ID NO: 756720

SEQ ID NO: 756722 - protein, 75 aa, Homo sapiens
IRTLRLWIEADATVPGKPHCPPIPALASVPVRSCTMLLSAILPSPALPACWSCIALHLTDSYSTALASPKHTWPS

SEQ ID NO: 756723 - protein, 148 aa, Homo sapiens
STLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPICK

SEQ ID NO: 756724 - protein, 435 aa, Homo sapiens
MATQTLSIDSYQDGQQMQVVTELKTEQDPNCSEPDAEGVSPPPVESQTPMDVDKQAIYRHPLFPLLALLFEKCEQSTQGSEGTTSASFDVDIENFVRKQEKEGKPFFCEDPETDNLMVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 756725 - protein, 217 aa, Homo sapiens
MATQTLSIDSYQDGQQMQVVTELKTEQDPNCSEPDAEGVSPPPVESQTPMDVDKQAIYRHPLFPLLALLFEKCEQSTQGSEGTTSASFDVDIENFVRKQEKEGKPFFCEDPETDNLMVKAIQVLRIHLLELEKVNELCKDFCSRYIACLKTKMNSETLLSGEPGSPYSPVQSQQIQSAITGTISPQGIVVPASALQQGNVAMATVAGTMTEKWTRSP

SEQ ID NO: 756726 - protein, 435 aa, Homo sapiens; identical to SEQ ID NO: 756724

SEQ ID NO: 756727 - protein, 435 aa, Homo sapiens; identical to SEQ ID NO: 756724

SEQ ID NO: 756728 - protein, 435 aa, Homo sapiens; identical to SEQ ID NO: 756724

SEQ ID NO: 756729 - protein, 283 aa, Homo sapiens [sequence omitted]

SEQ ID NO: 756730 - protein, 163 aa, Homo sapiens
MRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 756731 - protein, 164 aa, Homo sapiens
KAMVTFFFYFQHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 756732 - protein, 217 aa, Homo sapiens; identical to SEQ ID NO: 756725

SEQ ID NO: 756733 - protein, 71 aa, Homo sapiens
FQEGLAQLTSGKVSKLCDLGNRGGVLSSGVFCQLDSETLACWGEDEALMWSGQLWVGHLHHRALTRACYRP

SEQ ID NO: 756734 - protein, 653 aa, Homo sapiens
GTRSTPVTERSRLVCLRAAVPRMNPSTPSYPTASLYVGDLHPDVTEAMLYEKFSPAGPILSIRICRDLITSGSSNYAYVNFQHTKDAEHALDTMNFDVIKGKPVRIMWSQRDPSLRKSGVGNIFVKNLDKSINNKALYDTVSAFGNILSCNVVCDENGSKGYGFVHFETHEAAERAIKKMNGMLLNGRKVFVGQFKSRKEREAELGARAKEFPNVYIKNFGEDMDDERLKDLFGKFGPALSVKVMTDESGKSKGFGFVSFERHEDAQKAVDEMNGKELNGKQIYVGRAQKKVERQTELKRTFEQMKQDRITRYQVVNLYVKNLDDGIDDERLRKAFSPFGTITSAKVMMEGGRSKGFGFVCFSSPEEATKAVTEMNGRIVATKPLYVALAQRKEERQAYLTNEYMQRMASVRAVPNQRAPPSGYFMTAVPQTQNHAAYYPPSQIARLRPSPRWTAQGARPHPFQNKPSAIRPGAPRVPFSTMRPASSQVPRVMSTQRVANTSTQTVGPRPAAAAAAAATPAVRTVPRYKYAAGVRNPQQHRNAQPQVTMQQLAVHVQGQETLTASRLASAPPQKQKQMLGERLFPLIQAMHPTLAGKITGMLLEIDNSELLYMLESPESLRSKVDEAVAVLQAHQAKEATQKAVNSATGVPTV

SEQ ID NO: 756735 - protein, 653 aa, Homo sapiens; identical to SEQ ID NO: 756734

SEQ ID NO: 756736 - protein, 269 aa, Homo sapiens
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSVIANN

SEQ ID NO: 756737 - protein, 228 aa, Homo sapiens
LTELPRTHHDKDAAAVHFGGWRNDIALLKLANPVSLTDKIQLACLPPAGTILPNNYPCYVTGWGRLQTNGAVPDVLQQGRLLVVDYATCSSSAWWGSSVKTSMICAGGDGVISSCNVSLQYSSNGQWYHTCGGSLIANSWVLTAAHCISSSRIYRVMLGQHNLYVAESGSLAVSVSKIVVHKDWNSNQVSKGNELPVKWYPVSLTNNDKALVFTRVSNYIDWINSVIE

SEQ ID NO: 756738 - protein, 269 aa, Homo sapiens; identical to SEQ ID NO: 756736

SEQ ID NO: 756739 - protein, 473 aa, Homo sapiens
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSRLSCGVSTYAPDMSRMLGGDRSEAQQSVLLVEVSLQYSSNGQWYHTCGGSLIANSWVLTAAHCISSSRIYRVMLGQHNLYVAESGSLAVSVSKIVVHKDWNSNQVSKGNDIALLKLANPVSLTDKIQLACLPPAGTILPNNYPCYVTGWGRLQTNGALPDDLKQGQLLVVDYATCSSSGWWGSTVKTNMICAGGDGVICTCNVSTKNQG

SEQ ID NO: 756740 - protein, 215 aa, Homo sapiens
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNAT

SEQ ID NO: 756741 - protein, 274 aa, Homo sapiens
MICAGGDGVISSCNGDSGGPLNCQASDGRWQVHGIVSFGSRLGCNYYHKPSVFTRVSNYIDWINSRLSCGVSTYAPDMSRMLGGDRSEAQQSVLLVEVSLQYSSNGQWYHTCGGSLIANSWVLTAAHCISSSRIYRVMLGQHNLYVAESGSLAVSVSKIVVHKDWNSNQVSKGNDIALLKLANPVSLTDKIQLACLPPAGTILPNNYPCYVTGWGRLQTNGALPDDLKQGQLLVVDYATCSSSGWWGSTVKTNMICAGGDGVICTCNVSTKNQG

SEQ ID NO: 756742 - protein, 94 aa, Homo sapiens
QKGRLALHLNLGDSKARLSSSLPSATLGSLLDDQHWHSVLIERVGKQVNFTVDKHTQHFRTKGETDALDIDYELSFGGIPVPGKPGTFLKKNFH

SEQ ID NO: 756743 - protein, 131 aa, Homo sapiens
CPLSIHPSIHSSIHPFIHPSIYASIHPSTHPSIHPSIRLPIHSSIYLPIHLLIHSSIHPPTRPFIHPLIHPSSLESLRHAKDCPGYWRDRNERHYSCLQGTHSLVGCQKTKQMIPVQSVRCPEGQVASCLS

SEQ ID NO: 756744 - protein, 111 aa, Homo sapiens
MSLGLKDYAFTFNMKSMDGVYINNHVGLPILNPLVLVHTHMDISISTFTLVSKDKIKTHLVMYLIGFYSRFMNRCSLHSNRITASTGQWQTIGFCEVGMRKHNNGENKLIS

SEQ ID NO: 756745 - protein, 217 aa, Homo sapiens
GRVGRPTRRGRFSGDTGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 756746 - protein, 311 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPLPRRRGSVGAHNVARGDVECPKSAAGGPGCWPWRDASGHIHFWAVHLLWGFWPSMLAVRVRGHPVIRAYLPLLRCLRDSAGWR

SEQ ID NO: 756747 - protein, 173 aa, Homo sapiens
MSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 756748 - protein, 296 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPLPRRRGECLAAPQLWPTWRQWQCPPQSAAVEVPGLLALAENATQAPNYSTSLAMSTTLALWRRRCLCP

SEQ ID NO: 756749 - protein, 296 aa, Homo sapiens; identical to SEQ ID NO: 756748

SEQ ID NO: 756750 - protein, 296 aa, Homo sapiens; identical to SEQ ID NO: 756748

SEQ ID NO: 756751 - protein, 296 aa, Homo sapiens; identical to SEQ ID NO: 756748

SEQ ID NO: 756752 - protein, 296 aa, Homo sapiens; identical to SEQ ID NO: 756748

SEQ ID NO: 756753 - protein, 296 aa, Homo sapiens; identical to SEQ ID NO: 756748

SEQ ID NO: 756754 - protein, 296 aa, Homo sapiens; identical to SEQ ID NO: 756748

SEQ ID NO: 756755 - protein, 296 aa, Homo sapiens; identical to SEQ ID NO: 756748

SEQ ID NO: 756756 - protein, 296 aa, Homo sapiens; identical to SEQ ID NO: 756748

SEQ ID NO: 756757 - protein, 287 aa, Homo sapiens
MLATRRLLGWSLPARTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPLPRRRGECLAAPQLWPTWRQWQCPPQSAAVEVPGLLALAENATQAPNYSTSLAMSTTLALWRRRCLCP

SEQ ID NO: 756758 - protein, 288 aa, Homo sapiens
GRVGRPTRRGRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPLPRRRGECLAAPQLWPTWRQWQCPPQSAAVEVPGLLALAENATQAPNYSTSLAMSTTLALWRRRCLCP

SEQ ID NO: 756759 - protein, 173 aa, Homo sapiens; identical to SEQ ID NO: 756747

SEQ ID NO: 756760 - protein, 264 aa, Homo sapiens
HRTSRCGSDFSKLYGRYDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPLPRRRGECLAAPQLWPTWRQWQCPPQSAAVEVPGLLALAENATQAPNYSTSLAMSTTLALWRRRCLCP

SEQ ID NO: 756761 - protein, 278 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGAGLIGKNACGSGYDFDVFVVRGAGAYICGEETALIESIEGKQGKPRLKPPLPRRRGECLAAPQLWPTWRQWQCPPQSAAVEVPGLLALAENATQAPNYSTSLAMSTTLALWRRRCLCP

SEQ ID NO: 756762 - protein, 234 aa, Homo sapiens
MLVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 756763 - protein, 173 aa, Homo sapiens; identical to SEQ ID NO: 756747

SEQ ID NO: 756764 - protein, 310 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPLPRRRGSVWWPTLGQRGDRGVSPIAPEDRCGLQEARALSFAVAMSGGGLPPSSSRAGAPLSAPHSGSLAGLPLLSPVCAALA

SEQ ID NO: 756765 - protein, 206 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVGRERCRQMRRCSVCTHTPLTQHSCSEVLVPGDVRD

SEQ ID NO: 756766 - protein, 53 aa, Homo sapiens
MGARAAYIYIRGEFYNEASNLQVGRERCRQMRRCSVCTHTPLTQHSCSEVLVP

SEQ ID NO: 756767 - protein, 296 aa, Homo sapiens; identical to SEQ ID NO: 756748

SEQ ID NO: 756768 - protein, 296 aa, Homo sapiens; identical to SEQ ID NO: 756748

SEQ ID NO: 756769 - protein, 296 aa, Homo sapiens; identical to SEQ ID NO: 756748

SEQ ID NO: 756770 - protein, 296 aa, Homo sapiens; identical to SEQ ID NO: 756748

SEQ ID NO: 756771 - protein, 263 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPLPRRRGECLAAPQLWPTPCCDPWRLVYPTDPQVCV

SEQ ID NO: 756772 - protein, 309 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPLPRRRGECLAAPQLWPTWRQWQCPPQSAAVEVPGLLWLEKASGQSSFGCTLLGSLLNEPGGGTHDGPAQLQVGKASHGYIR

SEQ ID NO: 756773 - protein, 173 aa, Homo sapiens; identical to SEQ ID NO: 756747

SEQ ID NO: 756774 - protein, 173 aa, Homo sapiens; identical to SEQ ID NO: 756747

SEQ ID NO: 756775 - protein, 173 aa, Homo sapiens; identical to SEQ ID NO: 756747

SEQ ID NO: 756776 - protein, 311 aa, Homo sapiens; identical to SEQ ID NO: 756746

SEQ ID NO: 756777 - protein, 107 aa, Homo sapiens
MCSPEETAFIASVSQRSLMVLVSWAPRISVSPFVLKLTSLSWMAPWTSTSPSPSRHTGGTLVHREDACSGHQLESGRPWVPDLWTLPHRALPQSLLLPLAGWSWQGS

SEQ ID NO: 756778 - protein, 112 aa, Homo sapiens
KRAAVRGLGMETAFIASVSQRSLMVLVSWAPRISVSPFVLKLTSLSWMAPWTSTSPSPSRHTGGTLVHREDACSGHQLESGRPWVPDLWTLPHRALPQSLLLPLAGWSWQGS

SEQ ID NO: 756779 - protein, 70 aa, Homo sapiens
SGVFSADTSLVSSFIPGCQARQGTAAALVLTALATGLVTARSSCFCDLSAAFRHLSAGVFLGPCELPVLL

SEQ ID NO: 756780 - protein, 2008 aa, Homo sapiens
MVCLGTGQSAGPLVSVQNHCPPCGLSPQESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSQPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGRARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGSELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 756781 - protein, 2146 aa, Homo sapiens
MAFWTQLMLLLWKNFMYRRRQPVQLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLLRTESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSQPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGRARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGSELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 756782 - protein, 2020 aa, Homo sapiens
MVCLGTGQSAGPLVSVQNHCPPCGLSPQESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSQPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGRARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHRWAGLCCPGLWLSMEECEALCSRLAIMVNGRFRCLGSPQHLKGRFAAGHTLTLRVPAARSQPAAAFVAAEFPGSELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 756783 - protein, 1889 aa, Homo sapiens
RAAPSSPLDTLSFMEVGGGCWPQGVGLSHEGCVLVPGLLFEVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSQPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGRARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHRWAGLRCPGLWLSMEECEALCSRLAIMVNGRFRCLGSPQHLKGRFAAGHTLTLRVPAARSQPAAAFVAAEFPGSELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 756784 - protein, 762 aa, Homo sapiens
VYVPDLNPVISGYIKSVYGGFSLGGRDPGLPSGQELGRSVEELWALLSPLPGGALDRVLKNLTAWAHSLDAQDSLKIWFNNKGWHSMVAFVNRASNAILRAHLPPGRARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHRWAGLRCPGLWLSMEECEALCSRLAIMVNGRFRCLGSPQHLKGRFAAGHTLTLRVPAARSQPAAAFVAAEFPGSELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 756785 - protein, 1735 aa, Homo sapiens
MVCLGTGQSAGPLVSVQNHCPPCGLSPQESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSQPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGRARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGEVSPGVEARCRDSEWLPYCMPCPSSFTEHLLCIHHLLLGTYCMPIFVLLFLFY

SEQ ID NO: 756786 - protein, 2001 aa, Homo sapiens
MVCLGTGQSAGPLVSVQNHCPPCGLSPQESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSQPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGRARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGSELREAHGGRLRFQLPPGGRCALARVFGELAVHGAEHGVEDFSVSQTMLEEDQGKDEDTEEQKEAGVGVDPAPGLQHPKRVSQFLDDPSTAETVL

SEQ ID NO: 756787 - protein, 1639 aa, Homo sapiens
MVCLGTGQSAGPLVSVQNHCPPCGLSPQESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSQPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGRARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPPGWLLGPPAPVHGLHP

SEQ ID NO: 756788 - protein, 133 aa, Homo sapiens
MVFAAGHTLTLRVPAARSQPAAAFVAAEFPGSELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 756789 - protein, 1489 aa, Homo sapiens
MVCLGTGQSAGPLVSVQNHCPPCGLSPQESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSQPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGRARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYG

SEQ ID NO: 756790 - protein, 446 aa, Homo sapiens
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 756791 - protein, 242 aa, Homo sapiens
MSLGIMEEEDLAEYFRLQYGERLLQMLQKLPNVEGASESPSIWLLEKKKETEIMHQTMVQKKKMFQRRMETLNLRWEELGVKEAQLKAHIQKSEQFIQENDQKRIRAMKKANKERELKCQHMQELTKRKQEMVALRLEHQRLSAKLKDYYIFNKYLEKVVENSEESRWAHIQNTAAKKTLLLGTIKMATLNLFQIVSKHLKEVTEVALEDTHKQLDMIQQFIQDRSDIWAEVKKKEQQRVRI

SEQ ID NO: 756792 - protein, 104 aa, Homo sapiens [sequence omitted]

SEQ ID NO: 756793 - protein, 104 aa, Homo sapiens [sequence omitted]

SEQ ID NO: 756794 - protein, 173 aa, Homo sapiens [sequence omitted]

SEQ ID NO: 756795 - protein, 151 aa, Homo sapiens
MSYEVDLLTHEWVTTRSLETAGWTPTCAFQLLLEPQGPRKAVWSLQPGPSPGRNTSTFAKDSLIHHHGTQKKKMQKRRLKLWPTQGGCKLFEIFLVEKWGSKFPPLNLGRPSDCLTNRNSMEATLYRFLRLSLKRLAVPTSCHLGIIVLET

SEQ ID NO: 756796 - protein, 151 aa, Homo sapiens
SQDINSHLASLSMARNTSPTPDPTVREALCAPDNLNASIESQGQIKMYINEVCRETVSRCCNSFLQQAGLNLLISMTVINNMLAKSASDLKFPLISEGSGCAKVQVLKPLMGLSEKPVLAGELVGAQMLFSFMSLFIRNGNREILLETPAP

SEQ ID NO: 756797 - protein, 181 aa, Homo sapiens
MEPKRIREGYLVKKGSVFNTWKPMWVVLLEDGIEFYKKKSDNSPKGMIPLKGSTLTSPCQDFGKRMFVFKITTTKQQDHFFQAAFLEERDAWVRDIKKAIKCIEGGQKFARKSTRRSIRLPETIDLGALYLSMKDTEKGIKELNLEKDKKIFNHCFTGKSTCRPEIGRLGRRYGVLLRPRL

SEQ ID NO: 756798 - protein, 176 aa, Homo sapiens
MEPKRIREGYLVKKGSVFNTWKPMWVVLLEDGIEFYKKKSDNSPKGMIPLKGSTLTSPCQDFGKRMFVFKITTTKQQDHFFQAAFLEERDAWVRDIKKAIKCIEGGQKFARKSTRRSIRLPETIDLGPLYSPMNDTASQYLRIEVVASNQGRNSQDGLMNPLSLLMRGFLHISEMY

SEQ ID NO: 756799 - protein, 350 aa, Homo sapiens [sequence omitted]

SEQ ID NO: 756800 - protein, 350 aa, Homo sapiens [sequence omitted]

SEQ ID NO: 756801 - protein, 174 aa, Homo sapiens
MYTGMEEKGGGCPHGWRGGGMEMAQVAMCLRLVMLACCLIFQQPDSGFFCEENSSDDDVILKEEFRGVIIKQGCLLKQGHRRKNWKVRKFILREDPAYLHYYDPAGAEDPLGAIHLRGCVVTSVESNSNGRKSEEENLFEIITADEVHYFLQAATPKERTEWIKAIQMASRTGK

SEQ ID NO: 756802 - protein, 295 aa, Homo sapiens
MEPKRIREGYLVKKGSVFNTWKPMWVVLLEDGIEFYKKKSDNSPKGMIPLKGSTLTSPCQDFGKRMFVFKITTTKQQDHFFQAAFLEERDAWVRDIKKAIKCIEGGQKFARKSTRRSIRLPETIDLGALYLSMKDTEKGIKELNLEKDKKIFNHCFTGNCVIDWLVSNQSVRNRQEGLMIASSLLNEGYLQPAGDMSKSAVDGTAENPFLDNPDAFYYFPDSGFFCEENSSDDDVILKEEFRGVIIKQGCLLKQVSGHNCSHLAFSLYKVLFVSKLPSDFWFVWLIVKQKMKPTK

SEQ ID NO: 756803 - protein, 434 aa, Homo sapiens
SFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 756804 - protein, 434 aa, Homo sapiens; identical to SEQ ID NO: 756803

SEQ ID NO: 756805 - protein, 434 aa, Homo sapiens; identical to SEQ ID NO: 756803

SEQ ID NO: 756806 - protein, 219 aa, Homo sapiens
SFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSSSHRDLKSTT

SEQ ID NO: 756807 - protein, 434 aa, Homo sapiens; identical to SEQ ID NO: 756803

SEQ ID NO: 756808 - protein, 116 aa, Homo sapiens
TTSYHNPDIPFCDLRSSDKLNQLSTRKCLNSPTAWNPLSSTPSPPPTTSTCLFSGPNQCISQMYLIAVSCLPKMYKTKLHPNHLGHMFSGPPEGCVMGHGQSYLAQNKFLQIFYRV

SEQ ID NO: 756809 - protein, 496 aa, Homo sapiens
SLDFSMTTQLPAYVAILLFYVSRASCQDTFIAAVYEHAAILPNATLTPVSREEALALMNRNLDILEGAITSAADQGAHIIVTPEDAIYGWNFNRDSLYPYLEDIPDPEVNWIPCNNRNRFGQTPVQERLSCLAKNNSIYVVANIGDKKPCDTSDPQCPPDGRYQYNTDVVFDSQGKLVARYHKNTFGSFGIFTCFDILFHDPAVTLVKDFHVDTIVFPTAWMNVLPHLSAVEFHSAWAMGMRVNFLASNIHYPSKKMTGSGIYAPNSSRAFHYDMKTEEGKLLLSQLDSHPSHSAVVNWTSYASSIEALSSGNKEFKGTVFFDEFTFVKLTGVAGNYTVCQKDLCCHLSYKMSENIPNEVYALGAFDGLHTVEGRYYLQICTLLKCKTTNLNTCGDSAETASTRFEMFSLSGTFGTQYVFPEVLLSENQLAPGEFQVSTDGRLFSLKPTSGPVLTVTLFGRLYEKDWASNASSGLTAQARIIMLIVIAPIVCSLSW

SEQ ID NO: 756810 - protein, 496 aa, Homo sapiens; identical to SEQ ID NO: 756809

SEQ ID NO: 756811 - protein, 519 aa, Homo sapiens
SLDFSMTTQLPAYVAILLFYVSRASCQDTFIAAVYEHAAILPNATLTPVSREEALALMNRNLDILEGAITSAADQGAHIIVTPEDAIYGWNFNRDSLYPYLEDIPDPEVNWIPCNNRNRFGQTPVQERLSCLAKNNSIYVVANIGDKKPCDTSDPQCPPDGRYQYNTDVVFDSQGKLVARYHKKQNLFMGENQFNVPKEPEIVTFNTTFGSFGIFTCFDILFHDPAVTLVKDFHVDTIVFPTAWMNVLPHLSAVEFHSAWAMGMRVNFLASNIHYPSKKMTGSGIYAPNSSRAFHYDMKTEEGKLLLSQLDSHPSHSAVVNWTSYASSIEALSSGNKEFKGTVFFDEFTFVKLTGVAGNYTVCQKDLCCHLSYKMSENIPNEVYALGAFDGLHTVEGRYYLQICTLLKCKTTNLNTCGDSAETASTRFEMFSLSGTFGTQYVFPEVLLSENQLAPGEFQVSTDGRLFSLKPTSGPVLTVTLFGRLYEKDWASNASSGLTAQARIIMLIVIAPIVCSLSW

SEQ ID NO: 756812 - protein, 118 aa, Homo sapiens [sequence omitted]

SEQ ID NO: 756813 - protein, 172 aa, Homo sapiens
KARSAGRKAPVSALRAQSVPAAPPLSVPAAAATATMPNFAGTWKMRSSENFDELLKALGVNAMLRKVAVAAASKPHVEIRQDGDQFYIKTSTTVRTTEINFKVGEGFEEETVDGRKCRSLATWENENKIHCTQTLLEGDGPKTYWTRELANDELILTFGADDVVCTRIYVRE

SEQ ID NO: 756814 - protein, 103 aa, Homo sapiens
MTLGGVIHSSGMLRFLHDLEEGLWVRTTEINFKVGEGFEEETVDGRKCRSLATWENENKIHCTQTLLEGDGPKTYWTRELANDELILTFGADDVVCTRIYVRE

SEQ ID NO: 756815 - protein, 398 aa, Homo sapiens
AGREDQVRGPPSSEDRCKEYPAGGYSSPSGFAAMHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLEITILTSQPGKEVVKQLEEGLKDTDLARVRRFQVVEVTKGILEHVDSASPVEDTSNDESSILGTDIDLQTIDNDIVSMEIFFKAWLHNSGTDQEQIHLLLSSQCFSNISRPRDNPMCLKCDLQERLLCPSLLAGTADGSLRMDDPKGDFITLYQMASQSSASHYKLQVIKALKSSGLCESLTYGLPFILRPTSCWQLDWDELETNQQHFHALCHSLLVSTHVPR

SEQ ID NO: 756816 - protein, 450 aa, Homo sapiens
SGPGASSAGPPGPRAGLLIRQARCKEYPAGGYSSPSGFAAMHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLEITILTSQPGKEVVKQLEEGLKDTDLARVRRFQVVEVTKGILEHVDSASPVEDTSNDESSILGTDIDLQTIDNDIVSMEIFFKAWLHNSGTDQEQIHLLLSSQCFSNISRPRDNPMCLKCDLQERLLCPSLLAGTADGSLRMDDPKGDFITLYQMASQSSASHYKLQVIKALKSSGLCESLTYGLPFILRPTSCWQLDWDELETNQQHFHALCHSLLTGQLQTNRARATVAPLPMTPVPGRASKMPAASKSSSDAFFLPSEWEKDPSRP

SEQ ID NO: 756817 - protein, 468 aa, Homo sapiens
SGPGASSAGPPGPRAGLLIRQARCKEYPAGGYSSPSGFAAMHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLEITILTSQPGKEVVKQLEEGLKDTDLARVRRFQVVEVTKGILEHVDSASPVEDTSNDESSILGTDIDLQTIDNDIVSMEIFFKAWLHNSGTDQEQIHLLLSSQCFSNISRPRDNPMCLKCDLQERLLCPSLLAGTADGSLRMDDPKGDFITLYQMASQSSASHYKLQVIKALKSSGLCESLTYGLPFILRPTSCWQLDWDELETNQQHFHALCHSLLKREWLLLAKGEPPGPGHSQRIPASTFYVIMPSHSLTLLVKAVATRELMLPSTFPLLPEDPHDDSLKNVEA

SEQ ID NO: 756818 - protein, 1260 aa, Homo sapiens
MQKGIRLNDGHVASLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKTTEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKSDASLYCDDVDIRFSKTMNSCKVLQIRYASVERLLERLTDLRFLSIDFLNTFLHSYRVFTTAIVVLDKLITIYKKPISAIPARWLRSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 756819 - protein, 964 aa, Homo sapiens
MFLHQIFYQGLKARISSWPTLVLADLFDILLPMLNIYQEFVRNHQYSLQILAHCKQNRDFDKLLKTTEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKSDASLYCDDVDIRFSKTMNSCKVLQIRYASVERLLERLTDLRFLSIDFLNTFLHSYRVFTTAIVVLDKLITIYKKPISAIPARWLRSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 756820 - protein, 159 aa, Homo sapiens
GELPPPCIHQLVRPSAPGAPLHPPPHMAGFLVCRRHHRCLHCLWGPPFCLSPHPDRLPSFQVACGPVCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 756821 - protein, 489 aa, Homo sapiens
MYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 756822 - protein, 1273 aa, Homo sapiens
MQKGIRLNDGHVASLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKTTEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKRTREGTREAEMSRSDASLYCDDVDIRFSKTMNSCKVLQIRYASVERLLERLTDLRFLSIDFLNTFLHSYRVFTTAIVVLDKLITIYKKPISAIPARWLRSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 756823 - protein, 249 aa, Homo sapiens [sequence omitted]

SEQ ID NO: 756824 - protein, 249 aa, Homo sapiens [sequence omitted]

SEQ ID NO: 756825 - protein, 328 aa, Homo sapiens
MTGVFDSLVADMHSTQIAASSTYHQHQQPPSGGGAGPGGNSSSSSSLHKPQESPTLPVSTATDSSYYTNQQHPAGGGGGGGSPYAHMGSYQYQASGLNNVPYSAKSSYDLGYTAAYTSYAPYGTSSSPANNEPEKEDLEPEIRIVNGKPKKVRKPRTIYSSFQLAALQRRFQKTQYLALPERAELAASLGLTQTQVKIWFQNRRSKFKKMWKSGEIPSEQHPGASASPPCASPPVSAPASWDFGVPQRMAGGGGPGSGGSGAGSSGSSPSSAASAFLGNYPWYHQTSGSASHLQATAPLLHPTQTPQPHHHHHHHGGGGAPVSAGTIF

SEQ ID NO: 756826 - protein, 141 aa, Homo sapiens [sequence omitted]

SEQ ID NO: 756827 - protein, 479 aa, Homo sapiens
MSFGATPKMSPEMGELTQTRLQKIWIPHSSGSSRLQRRRGSSIPQFTNSPTMVIMVGLPARGKTYISTKLTRYLNWIGTPTKVFNLGQYRREAVSYKNYEFFLPDNMEALQIRKQCALAALKDVHNYLSHEEGHVAVFDATNTTRERRSLILQFAKEHGYKVFFIESICNDPGIIAENIRQVKLGSPDYIDCDREKVLEDFLKRIECYEVNYQPLDEELDSHLSYIKIFDVGTRYMVNRVQDHIQSRTVYYLMNIHVTPRSIYLCRHGESELNIRGRIGGDSGLSVRGKQYAYALANFIQSQGISSLKVWTSHMKRTIQTAEALGVPYEQWKALNEIDAGVCEEMTYEEIQEHYPEEFALRDQDKYRYRYPKGESYEDLVQRLEPVIMELERQENVLVICHQAVMRCLLAYFLDKSSDELPYLKCPLHTVLKLTPVAYGCKVESIYLNVEAVNTHREKPENVDITREPEEALDTVPAHY

SEQ ID NO: 756828 - protein, 431 aa, Homo sapiens
MSFGATPKMSPEMGELTQTRLQKIWIPHSSGSSRLQRRRGSSIPQFTNSPTMVIMVGLPARGKTYISTKLTRYLNWIGTPTKVFNLGQYRREAVSYKNYEFFLPDNMEALQIRKQCALAALKDVHNYLSHEEGHVAVFDATNTTRERRSLILQFAKEHGYKVFFIESICNDPGIIAENIRQVKLGSPDYIDCDREKVLEDFLKRIECYEVNYQPLDEELDSHLSYIKIFDVGTRYMVNRVQDHIQSRTVYYLMNIHVTPRSIYLCRHGESELNIRGRIGGDSGLSVRGKQYAYALANFIQSQGISSLKVWTSHMKRTIQTAEALGVPYEQWKALNEIDAGVCEEMTYEEIQEHYPEEFALRDQDKYRYRYPKGESYEDLVQRLEPVIMELERQENVLVICHQAVMRCLLAYFLDKSSGTTLISALGMFDGI

SEQ ID NO: 756829 - protein, 607 aa, Homo sapiens
FPGGWQMRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 756830 - protein, 607 aa, Homo sapiens; identical to SEQ ID NO: 756829

SEQ ID NO: 756831 - protein, 688 aa, Homo sapiens
FPGGWQMRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCVCLGSQFPPVAYGGPGFSRRPLFSPSIALVPCPLGSAQALPVTGTHDAESCVISSPCPERSDGQGEVGVLTVAWDSEASGGPVELSLPTGSGRWLSALLGGHLGHSRLSLTPR

SEQ ID NO: 756832 - protein, 688 aa, Homo sapiens; identical to SEQ ID NO: 756831

SEQ ID NO: 756833 - protein, 664 aa, Homo sapiens
FPGGWQMRVVRLLRLRAALTLLGEVPRRPASRGVPGSRRTQKGSGARNSQKGPFRNVCCTCFPLSDPSETSCCSEDTHPSRPGPPGPQQHYLAGVTCRSPGSGRWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 756834 - protein, 690 aa, Homo sapiens
LSRRLADARGAAAAAPGGSDAARGGPPPPGLPGCPGLAQDAEGQWSQELGTQREPQMGQGVLGGGSSGLRLELGLAVGPALRHISPRVHRQTLQRLPVALRTLIPADQAHQAPNSTTWLGSRAGLLALARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 756835 - protein, 607 aa, Homo sapiens; identical to SEQ ID NO: 756829

SEQ ID NO: 756836 - protein, 607 aa, Homo sapiens; identical to SEQ ID NO: 756829

SEQ ID NO: 756837 - protein, 620 aa, Homo sapiens
FPGGWQMRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSPARGLAASSSLASVLEKKRRLLEKLQEQLAQLSVQATDKEENKQVALGTSKLNYLDPRISIAWCKRFRVPVEKIYSKTQRERFAWALAMAGEDFEF

SEQ ID NO: 756838 - protein, 503 aa, Homo sapiens
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 756839 - protein, 447 aa, Homo sapiens
VKAGRRMKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 756840 - protein, 266 aa, Homo sapiens
IATWQGCGVCWGPLWGHDLRRVCGGRELSTFHGLEGPHRGPSGTHGVEAGMGSCGEIPGWSGAWNRPLGGPSSFSAQGLPAEPCMAEEVCSMSWYTPMPIKKGSVVMRVDISSNGLGTFIPDKRYPFPRRGLGWTPGEFLTPGSPEEPVGDPRERMGRGEAATSCGTPEHWDLTCAYSAPAARFQMNINGFLKRDRDNNIQFTVGEELFNLMPQYFVGVSSRPLWHTVDQSPVLILGGIPNEKYVLMTDTSFKDFSLVEVNGVGQM

SEQ ID NO: 756841 - protein, 161 aa, Homo sapiens
QTPPPAAWLSLTPKGNLMVPVFIGCPPGKRLAFDITYTLEYSRLKNKHYFDCVNVNPEMPCFLFRDSVCPVPSPAQFTALLPPLLCALPPHSSPRRLPTLFPAASHFPPSRSSASRAKLISSSGLNPLQPHSFLPLLLDSRFGDRRLRQFPGQVKAWPACS

SEQ ID NO: 756842 - protein, 1272 aa, Homo sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKVGVRRRAGRPETGLGQPGAGLEGEAWRLSPRCPIPSRCRAIPAAVRGPGARPHLALVGEQQTRPGRRSGLGAGKGAAPGHPSPCPTPGADSAPRIRYPKDYYFFLASNWRSAGGVSIEMDSYEKIYNLESAYELPERIFLDKGTEYSFAIFLSAQGHSFRTQSELGLRGTRVEPEGRGEGYQNLGAWGAGTPSEGRGLSVDVGVVLADPGCIEASVKQEVLINRNSVLFSITLKDKKLCYDQGISGHHLMETSMTVNVRSKPGGEGKRLAFDITYTLEYSRLKNKHYFDCVNVNPEMPCFLFRDSVCPVPSPAQFTALLPPLLCALPPHSSPRRLPTLFPAASHFPPSRSSASRAKLISSSGLNPSNPIVFYPFFLIQDLVTGDSGSFQGSYVLLVVGGGPTLDSLKDYSEDEIYRFNSPLDKTNSLIWTTRTTRTTKDSAFHIMSHESPGIEGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 756843 - protein, 997 aa, Homo sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKDYYFFLASNWRSAGGVSIEMDSYEKIYNLESAYELPERIFLDKGTEYSFAIFLSAQGHSFRTQSELGLRGTRVEPEGRGEGYQNLGAWGAGTPSEGRGLSVDVGVVLADPGCIEASVKQEVLINRNSVLFSITLKDKKLCYDQGISGHHLMETSMTVNVRSKPGGEGKRLAFDITYTLEYSRLKNKHYFDCVNVNPEMPCFLFRDIYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNR

SEQ ID NO: 756844 - protein, 932 aa, Homo sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKSPVNFYRWKIEQLQIQMEAAPFRSKGFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKDYYFFLASNWRSAGGVSIEMDSYEKIYNLESAYELPERIFLDKGTEYSFAIFLSAQGHSFRTQSELGLRGTRVEPEGRGEGYQNLGAWGAGTPSEGRGLSVDVGVVLADPGCIEASVKQEVLINRNSVLFSITLKDKKLCYDQGISGHHLMETSMTVNVRSKPGGEGKRLAFDITYTLEYSRLKNKHYFDCVNVNPEMPCFLFRDIYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNR

SEQ ID NO: 756845 - protein, 1097 aa, Homo sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKTESCAVAQTGVQWRDLGSLQPPPPVFKRCSCLGLPSELELQPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRYPFPRRGLGWTPGEFLTPGSPEEPVGDPRERMGRGEAATSCGTPEHWDLTCAYSAPAARFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKDYYFFLASNWRSAGGVSIEMDSYEKIYNLESAYELPERIFLDKGTEYSFAIFLSAQGHSFRTQSELGLRGTRVEPEGRGEGYQNLGAWGAGTPSEGRGLSVDVGVVLADPGCIEASVKQEVLINRNSVLFSITLKDKKLCYDQGISGHHLMETSMTVNVRSKPGGEGKRLAFDITYTLEYSRLKNKHYFDCVNVNPEMPCFLFRDIYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNR

SEQ ID NO: 756846 - protein, 282 aa, Homo sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVETGNGPTP

SEQ ID NO: 756847 - protein, 272 aa, Homo sapiens
GLCFQETHLGPHMQGNLMVPVFIGCPPGKRLAFDITYTLEYSRLKNKHYFDCVNVNPEMPCFLFRDSLFYPFFLIQDLVTGDSGSFQGSYVLLVVGGGPTLDSLKDYSEDEIYRFNSPLDKTNSLIWTTRTTRTTKDSAFHIMSHESPGIEGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 756848 - protein, 101 aa, Homo sapiens
RPPRVLERSGFHNENSLAIYQGLVYYLLWLHSVYDKVGVRRRAGRPETGLGQPGAGLEGEACGAERSGIGEQDWWWVGGGPGGGAWLEQDFQGKALGVWPG

SEQ ID NO: 756849 - protein, 70 aa, Homo sapiens
MESQESGESVGVPPVPPWQLFNLMPQYFVGVSSRPLWHTVDQSPVLILGGIPNEKYVLMTDTSFKDFSLV

SEQ ID NO: 756850 - protein, 997 aa, Homo sapiens; identical to SEQ ID NO: 756843

SEQ ID NO: 756851 - protein, 1194 aa, Homo sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGLRGTRVEPEGRGEGYQNLGAWGAGTPSEGRGLSVDVGVVLADPGCIEASVKQEVLINRNSVLFSITLKDKKLCYDQGISGHHLMETSMTVNVRSKPGGEGKRLAFDITYTLEYSRLKNKHYFDCVNVNPEMPCFLFRDSVCPVPSPAQFTALLPPLLCALPPHSSPRRLPTLFPAASHFPPSRSSASRAKLISSSGLNPSNPIVFYPFFLIQDLVTGDSGSFQGSYVLLVVGGGPTLDSLKDYSEDEIYRFNSPLDKTNSLIWTTRTTRTTKDSAFHIMSHESPGIEGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 756852 - protein, 282 aa, Homo sapiens; identical to SEQ ID NO: 756846

SEQ ID NO: 756853 - protein, 922 aa, Homo sapiens
IATWQGCGVCWGPLWGHDLRRVCGGRELSTFHGLEGPHRGPSGTHGVEAGMGSCGEIPGWSGAWNRPLGGPSSFSAQGLPAEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKDYYFFLASNWRSAGGVSIEMDSYEKIYNLESAYELPERIFLDKGTEYSFAIFLSAQGHSFRTQSELGLRGTRVEPEGRGEGYQNLGAWGAGTPSEGRGLSVDVGVVLADPGCIEASVKQEVLINRNSVLFSITLKDKKLCYDQGISGHHLMETSMTVNVRSKPGGEGKRLAFDITYTLEYSRLKNKHYFDCVNVNPEMPCFLFRDIYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNR

SEQ ID NO: 756854 - protein, 562 aa, Homo sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEVGCPAPLPVPSLPTPKPQGPLFPPSQ

SEQ ID NO: 756855 - protein, 164 aa, Homo sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEV

SEQ ID NO: 756856 - protein, 195 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPPTQFI

SEQ ID NO: 756857 - protein, 99 aa, Homo sapiens
NRARTAPPDGEVREDLRLPEGDLGKEIEQKYDCGEEILITVLSAMTEEAAVAIKAMAKITGSQGGGGGSSDPLNLQRPPPRAWPGSGPVLSWTPPTQFI

SEQ ID NO: 756858 - protein, 254 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILVWCLPPCFCAQLCSVRFFLSSDISWLSLLLLQITVLSAMTEEAAVAIKAMAKITGSQRGWQAVISDLEAPPRLAVGRLVDPPFWFLVPPCGRLTRRGGGAFPGGGGRIDGGPVILLFGCG

SEQ ID NO: 756859 - protein, 108 aa, Homo sapiens
MADDLDFETGDAGASATFPMQCSALRKNGFVVLKGRPCKIVEMSTSKTGKHGHAKVHLVGIDIFTGKLNSLNNMKYFILIEEKNKHSEFFSKVKKDQLNKQKQKPTTQ

SEQ ID NO: 756860 - protein, 195 aa, Homo sapiens; identical to SEQ ID NO: 756856

SEQ ID NO: 756861 - protein, 247 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPSKNYCTVIWEIPPLFGEALALTMILGQEQTKLCAVYNDLLLSRLISPVWGQRAGVRA

SEQ ID NO: 756862 - protein, 195 aa, Homo sapiens; identical to SEQ ID NO: 756856

SEQ ID NO: 756863 - protein, 195 aa, Homo sapiens; identical to SEQ ID NO: 756856

SEQ ID NO: 756864 - protein, 195 aa, Homo sapiens; identical to SEQ ID NO: 756856

SEQ ID NO: 756865 - protein, 195 aa, Homo sapiens; identical to SEQ ID NO: 756856

SEQ ID NO: 756866 - protein, 195 aa, Homo sapiens; identical to SEQ ID NO: 756856

SEQ ID NO: 756867 - protein, 195 aa, Homo sapiens; identical to SEQ ID NO: 756856

SEQ ID NO: 756868 - protein, 195 aa, Homo sapiens; identical to SEQ ID NO: 756856

SEQ ID NO: 756869 - protein, 195 aa, Homo sapiens; identical to SEQ ID NO: 756856

SEQ ID NO: 756870 - protein, 195 aa, Homo sapiens; identical to SEQ ID NO: 756856

SEQ ID NO: 756871 - protein, 195 aa, Homo sapiens; identical to SEQ ID NO: 756856

SEQ ID NO: 756872 - protein, 195 aa, Homo sapiens; identical to SEQ ID NO: 756856

SEQ ID NO: 756873 - protein, 195 aa, Homo sapiens; identical to SEQ ID NO: 756856

SEQ ID NO: 756874 - protein, 193 aa, Homo sapiens
MKHDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPPTQFI

SEQ ID NO: 756875 - protein, 212 aa, Homo sapiens
LFQVTGLGFRLYDFIGRGSTFTDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPPTQFI

SEQ ID NO: 756876 - protein, 195 aa, Homo sapiens; identical to SEQ ID NO: 756856

SEQ ID NO: 756877 - protein, 178 aa, Homo sapiens
EYDCGEEILIIGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPPTQFI

SEQ ID NO: 756878 - protein, 184 aa, Homo sapiens
RIERGEPKLRPLQPESYGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPPTQFI

SEQ ID NO: 756879 - protein, 279 aa, Homo sapiens
CYCVLSIGNQKGGEGVRPVCSSGGGGRGGGGGGSGLGGSGWARGERTGSSQCVRASWNRSLLKWQMTWTSRQEMQGPQPPSQCSAQHYVRMALWCSKAGHVRSSRCLLRRLASTATPRLEFHLRILPSPCLQYLWRSQQQAANSADFPLTLLLLSDCFCLALSLHTHSDNYTCSPVFSLFCGYPSVPASFSGSPSVSPALCQSLQFIGLYALAIQLLLPYSWFSLFLSSLEPLLSGCFHHVAQGFSNSTPSPGGTPASILSFQVTLLLRSPVLAFPLEL

SEQ ID NO: 756880 - protein, 195 aa, Homo sapiens; identical to SEQ ID NO: 756856

SEQ ID NO: 756881 - protein, 195 aa, Homo sapiens; identical to SEQ ID NO: 756856

SEQ ID NO: 756882 - protein, 99 aa, Homo sapiens; identical to SEQ ID NO: 756857

SEQ ID NO: 756883 - protein, 195 aa, Homo sapiens; identical to SEQ ID NO: 756856

SEQ ID NO: 756884 - protein, 191 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGECDKSLTVPFTFCCPQQSCCSLNCFRLTFCP

SEQ ID NO: 756885 - protein, 112 aa, Homo sapiens
VVGDGEKGTAWHRSRGRCSVGDGSMQLGTGTGRDEDDGKVEQKYDCGEEILITVLSAMTEEAAVAIKAMAKITGSQGGGGGSSDPLNLQRPPPRAWPGSGPVLSWTPPTQFI

SEQ ID NO: 756886 - protein, 247 aa, Homo sapiens; identical to SEQ ID NO: 756861

SEQ ID NO: 756887 - protein, 200 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPLLARSNGDPL

SEQ ID NO: 756888 - protein, 135 aa, Homo sapiens
KVLFIHLPKNQDSYEEGDLKWWYSSPNIKRNDFQLIGIQDGYLSLLQDSGEVREDLRLPEGDLGKEIEQKYDCGEEILITVLSAMTEEAAVAIKAMAKITGSQGECDKSLTVPFTFCCPQQSCCSLNCFRLTFCP

SEQ ID NO: 756889 - protein, 195 aa, Homo sapiens; identical to SEQ ID NO: 756856

SEQ ID NO: 756890 - protein, 173 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQDGGGGSSDAALARS

SEQ ID NO: 756891 - protein, 202 aa, Homo sapiens
CYCVLSIGNQKGGEGVRPVCSSGGGGRGGGGGGSGLGGSGWARGERTGSSQCVRASWNRSLLKWQMTWTSRQEMQGPQPPSQCSAQHYVRMALWCSKAGHVRSSRCLLRRLASTATPRLEFHLRILPSPCLQYLWRSQQQAANSADFPLTLLLLSDCFCLALSLHTHASQYLWRSPPASCPPVLTFPLTLLLQSDCFCLALT

SEQ ID NO: 756892 - protein, 279 aa, Homo sapiens; identical to SEQ ID NO: 756879

SEQ ID NO: 756893 - protein, 160 aa, Homo sapiens
MLPDILIQSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPPTQFI

SEQ ID NO: 756894 - protein, 153 aa, Homo sapiens
MSKSESPKEPEQLRKLFIGGLSFEKLMAPQAPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPPTQFI

SEQ ID NO: 756895 - protein, 195 aa, Homo sapiens; identical to SEQ ID NO: 756856

SEQ ID NO: 756896 - protein, 195 aa, Homo sapiens; identical to SEQ ID NO: 756856

SEQ ID NO: 756897 - protein, 223 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILVWCLPPCFCAQLCSVRFFLSSDISWLSLLLLQITVLSAMTEEAAVAIKAMAKITGSQGECDKSLTVPFTFCCPQQSCCSLNCFRLTFCP

SEQ ID NO: 756898 - protein, 216 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQDGGGGSSDRLWPGPKLDSSYTIYLTFYFGFPHPLNLSGSPCPSPSSLGQERAKLWPW

SEQ ID NO: 756899 - protein, 206 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAKITGSQGGGGGSSDPLNLQRPPPRAWPGSGPVLSWTPWCLWPPWCLWPPWCLW

SEQ ID NO: 756900 - protein, 216 aa, Homo sapiens; identical to SEQ ID NO: 756898

SEQ ID NO: 756901 - protein, 91 aa, Homo sapiens
VVGDGEKGTAWHRSRGRCSVGDGSMQLGTGTGRDEDDGKVEQKYDCGEEILITVLSAMTEEAAVAIKAMAKITGSQGSGPVLSWTPPTQFI

SEQ ID NO: 756902 - protein, 132 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEMMTPPTHFFL

SEQ ID NO: 756903 - protein, 334 aa, Homo sapiens
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 756904 - protein, 186 aa, Homo sapiens
GRVGRPTHGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 756905 - protein, 334 aa, Homo sapiens; identical to SEQ ID NO: 756903

SEQ ID NO: 756906 - protein, 357 aa, Homo sapiens
MLPCARELPSAAPDSTLLLTAQHWVANLFILATLIGWTVRSFFLGRMETCCSHLGLRSGRRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 756907 - protein, 427 aa, Homo sapiens
LGTRLGLNRPRLWLAPSPAARRPRFHVPGGHSSQEPPRPWPLGRGNPLSPPAVPPRAATQTTRACAAPAKMLPCARELPSAAPDSTLLLTAQHWVANLFILATLIGWTVRSFFLGRMETCCSHLGLRSGRRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 756908 - protein, 234 aa, Homo sapiens
MDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 756909 - protein, 279 aa, Homo sapiens
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 756910 - protein, 207 aa, Homo sapiens
SSFPSSHRCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 756911 - protein, 334 aa, Homo sapiens; identical to SEQ ID NO: 756903

SEQ ID NO: 756912 - protein, 334 aa, Homo sapiens; identical to SEQ ID NO: 756903

SEQ ID NO: 756913 - protein, 334 aa, Homo sapiens; identical to SEQ ID NO: 756903

SEQ ID NO: 756914 - protein, 148 aa, Homo sapiens [sequence omitted]

SEQ ID NO: 756915 - protein, 227 aa, Homo sapiens
MATRQRESSITSCCSTSSCDADDEGVRGTCEDASLCKRFAVSIGYWHDPYIQHFVRLSKERKAPEINRGYFARVHGVSQLIKALPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 756916 - protein, 268 aa, Homo sapiens
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQDRIT

SEQ ID NO: 756917 - protein, 358 aa, Homo sapiens
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRAEGDNLLICRRLMPSQKPKPLALLEETCKLPERWAGLVRRSHPTLLRSLGHYSGRTCSSSCSC

SEQ ID NO: 756918 - protein, 334 aa, Homo sapiens; identical to SEQ ID NO: 756903

SEQ ID NO: 756919 - protein, 314 aa, Homo sapiens
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENKERLLSNGWETASAVDMMELYNRLPRAEVSRIESLEFLDEMELLEQLMRHYCLCWATKGGNELGLKEITY

SEQ ID NO: 756920 - protein, 135 aa, Homo sapiens
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIK

SEQ ID NO: 756921 - protein, 121 aa, Homo sapiens
MASPDRSKRKILKAKKTMPLSCRKQVEMLNKSRNVEALKTAIGSNVPSGNQSFSPSVITRTTEITKCSPSENGASSLDSNKNSISEKSKVFSQNCIKPVEEIVHSETKLEQVVCSYQKPSR

SEQ ID NO: 756922 - protein, 72 aa, Homo sapiens
KKVVDLDIQIPLCPRPLDVCLKAHWLSIEGFQAKADLLLSTQPGREEGSPLELERLKLEPHEGLLLRFPYAA

SEQ ID NO: 756923 - protein, 267 aa, Homo sapiens
LQDLMETRLSDQRSKERSLLHGDFHAFSAGPGLFSYIRHWDQNERFLVVLNFGDVGLSAGLQASDLPASASLPAKADLLLSTQPGLVEAPVMLWDESSFPDIPGAVSANMTVKGQSEDPGSLLSLFRRLSDQRSKERSLLHGDFHAFSAGPGLFSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQAVRRAPLLSWNA

SEQ ID NO: 756924 - protein, 229 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRASVSFWTLLPTTGVRTRGSPLRLTLWPPR

SEQ ID NO: 756925 - protein, 229 aa, Homo sapiens; identical to SEQ ID NO: 756924

SEQ ID NO: 756926 - protein, 229 aa, Homo sapiens; identical to SEQ ID NO: 756924

SEQ ID NO: 756927 - protein, 229 aa, Homo sapiens; identical to SEQ ID NO: 756924

SEQ ID NO: 756928 - protein, 229 aa, Homo sapiens; identical to SEQ ID NO: 756924

SEQ ID NO: 756929 - protein, 229 aa, Homo sapiens; identical to SEQ ID NO: 756924

SEQ ID NO: 756930 - protein, 299 aa, Homo sapiens
MELQPPEASIAVVSIPRQLPGSHSEAGVQGLSAGDDSETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRASVSFWTLLPTTGVRTRGSPLRLTLWPPR

SEQ ID NO: 756931 - protein, 330 aa, Homo sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRASVSFWTLLPTTGVRTRGSPLRLTLWPPR

SEQ ID NO: 756932 - protein, 362 aa, Homo sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTVETGFHHVSQADIEFLTSIDPTASASGSAGITGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRASVSFWTLLPTTGVRTRGSPLRLTLWPPR

SEQ ID NO: 756933 - protein, 292 aa, Homo sapiens
MELQPPEASIAVVSIPRQLPGSHSEAGVQGLSAGDDSGTGSRAKLGRRSPLVGPFRESMSGRTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRASVSFWTLLPTTGVRTRGSPLRLTLWPPR

SEQ ID NO: 756934 - protein, 229 aa, Homo sapiens; identical to SEQ ID NO: 756924

SEQ ID NO: 756935 - protein, 277 aa, Homo sapiens
MELQPPEASIAVVSIPRQLPGSHSEAGVQGLSAGDDSGTMSQDTEVDMKEVELNELEPEKQPMNAASGAAMSLAGAEKNGLVKINFPPKKKGGGVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRASVSFWTLLPTTGVRTRGSPLRLTLWPPR

SEQ ID NO: 756936 - protein, 229 aa, Homo sapiens; identical to SEQ ID NO: 756924

SEQ ID NO: 756937 - protein, 108 aa, Homo sapiens
MPLAIAGAAESLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRK

SEQ ID NO: 756938 - protein, 229 aa, Homo sapiens; identical to SEQ ID NO: 756924

SEQ ID NO: 756939 - protein, 229 aa, Homo sapiens; identical to SEQ ID NO: 756924

SEQ ID NO: 756940 - protein, 229 aa, Homo sapiens; identical to SEQ ID NO: 756924

SEQ ID NO: 756941 - protein, 227 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRKKQSRCQFLGPLTPQTYPGVEENSLGF

SEQ ID NO: 756942 - protein, 291 aa, Homo sapiens
MELQPPEASIAVVSIPRQLPGSHSEAGVQGLSAGDDSETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRSGYPGVPKETARKDLARGKVG

SEQ ID NO: 756943 - protein, 229 aa, Homo sapiens; identical to SEQ ID NO: 756924

SEQ ID NO: 756944 - protein, 229 aa, Homo sapiens; identical to SEQ ID NO: 756924

SEQ ID NO: 756945 - protein, 330 aa, Homo sapiens; identical to SEQ ID NO: 756931

SEQ ID NO: 756946 - protein, 229 aa, Homo sapiens; identical to SEQ ID NO: 756924

SEQ ID NO: 756947 - protein, 229 aa, Homo sapiens; identical to SEQ ID NO: 756924

SEQ ID NO: 756948 - protein, 268 aa, Homo sapiens
MELQPPEASIAVVSIPRQLPGSHSEAGVQGLSAGDDSGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRASVSFWTLLPTTGVRTRGSPLRLTLWPPR

SEQ ID NO: 756949 - protein, 442 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRTSMIASSSVVLGIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRK

SEQ ID NO: 756950 - protein, 229 aa, Homo sapiens; identical to SEQ ID NO: 756924

SEQ ID NO: 756951 - protein, 107 aa, Homo sapiens
MSQDTEVDMKEVELNELEPEKQPMNAASGAAMSLAGAEKNGLVKIKVAEDEAEAAAAAKFTGLSKEELLFSATGMRLAWMQLPFLDSLWRLQSCCGMSPASLTSQGL

SEQ ID NO: 756952 - protein, 229 aa, Homo sapiens; identical to SEQ ID NO: 756924

SEQ ID NO: 756953 - protein, 229 aa, Homo sapiens; identical to SEQ ID NO: 756924

SEQ ID NO: 756954 - protein, 221 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLADRPQFWLQGKILTVSCNRLKKRSGYPGVPKETARKDLARGKVG

SEQ ID NO: 756955 - protein, 106 aa, Homo sapiens
MSVKGGGDFKQGDQEDLVDNFGSEHTPSGCRIVSPLLPLFGTSSLQRDLVYRQWNFPDATQYVTLQQIEEANMRIISSMESETQFAKMKNNVTLLTILFGYTIMFN

SEQ ID NO: 756956 - protein, 230 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEGWKFVKLICKYNVHITL

SEQ ID NO: 756957 - protein, 681 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 756958 - protein, 681 aa, Homo sapiens; identical to SEQ ID NO: 756957

SEQ ID NO: 756959 - protein, 681 aa, Homo sapiens; identical to SEQ ID NO: 756957

SEQ ID NO: 756960 - protein, 681 aa, Homo sapiens; identical to SEQ ID NO: 756957

SEQ ID NO: 756961 - protein, 230 aa, Homo sapiens; identical to SEQ ID NO: 756956

SEQ ID NO: 756962 - protein, 415 aa, Homo sapiens
RTRGSTHASGPTRPITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 756963 - protein, 656 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPHPPPIWTAKFSGLPRDIIENYLYE

SEQ ID NO: 756964 - protein, 647 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRATKLRSCRVT

SEQ ID NO: 756965 - protein, 257 aa, Homo sapiens [sequence omitted]

SEQ ID NO: 756966 - protein, 264 aa, Homo sapiens [sequence omitted]

SEQ ID NO: 756967 - protein, 557 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQG

SEQ ID NO: 756968 - protein, 244 aa, Homo sapiens
PKVLGLQYFNATTNAMPLDWIGLQAVRIEKIKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 756969 - protein, 441 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHQLLQFVCASITPV

SEQ ID NO: 756970 - protein, 223 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLAAVHYQTH

SEQ ID NO: 756971 - protein, 124 aa, Homo sapiens
MTHLSFLYNRYAGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 756972 - protein, 107 aa, Homo sapiens
MAQLKISQGNISKACLILRSIEELKHKPGMVSALVTMYSHEEDIDSAIEVFTQAIQWYQNHQPKSPAHLSLIREAANFKLKYGRKKEAISVPRQQRYQPPTDILIVV

SEQ ID NO: 756973 - protein, 681 aa, Homo sapiens; identical to SEQ ID NO: 756957

SEQ ID NO: 756974 - protein, 683 aa, Homo sapiens
KDTPPPTIIKKKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 756975 - protein, 681 aa, Homo sapiens; identical to SEQ ID NO: 756957

SEQ ID NO: 756976 - protein, 682 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKVSVTLGI

SEQ ID NO: 756977 - protein, 558 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGA

SEQ ID NO: 756978 - protein, 427 aa, Homo sapiens
HGGIHDASSGDCGVFAQVQCPEKTEGCHPHDHACLQELLSCQKPIEQEVGWRCQAKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 756979 - protein, 412 aa, Homo sapiens
KLAAVQTANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 756980 - protein, 293 aa, Homo sapiens [sequence omitted]

SEQ ID NO: 756981 - protein, 284 aa, Homo sapiens
VVFDVMSHIDDRKTLAHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 756982 - protein, 560 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGD

SEQ ID NO: 756983 - protein, 464 aa, Homo sapiens
LPAPPLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPALLSRTNEQV

SEQ ID NO: 756984 - protein, 102 aa, Homo sapiens
MDGPWFTKATGKKWLWTRGRKKGKKKDQIGKGTQGATAGASSELDASKTVSSPPTSPRPGSAATVSASTSNIIPPRHQKPAGAPATKKKQQQKKKKGGKGGW

SEQ ID NO: 756985 - protein, 230 aa, Homo sapiens; identical to SEQ ID NO: 756956

SEQ ID NO: 756986 - protein, 87 aa, Homo sapiens [sequence omitted]

SEQ ID NO: 756987 - protein, 490 aa, Homo sapiens
MDPAVALVLCLSCLFLLSLWRQSSGRGRLPSGPTPLPIIGNILQLDVKDMSKSLTNLSKIYGPVFTLYFGLERMVVLHGYEVVKEALIDLGEEFSGRGHFPLAERANRGFGIVFSNGKRWKEIRRFSLMTLRNFGMGKRSIEDRVQEEARCLVEELRKTKASPCDPTFILGCAPCNVICSIIFQKRFDYKDQQFLNLMEKLNENIRIVSTPWIQICNNFPTIIDYFPGTHNKLLKNLAFMESDILEKVKEHQESMDINNPRDFIDCFLIKMEKEKQNQQSEFTIENLVITAADLLGAGTETTSTTLRYALLLLLKHPEVTAKVQEEIERVVGRNRSPCMQDRGHMPYTDAVVHEVQRYIDLIPTSLPHAVTCDVKFRNYLIPKGTTILTSLTSVLHDNKEFPNPEMFDPRHFLDEGGNFKKSNYFMPFSAGKRICVGEGLARMELFLFLTFILQNFNLKSLIDPKDLDTTPVVNGFASVPPFYQLCFIPV

SEQ ID NO: 756988 - protein, 752 aa, Homo sapiens
SCRIRHENTGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSSMDPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAALKNYGPVFTLYFGLERMVVLHGYEVVKEALIDLGEEFSGRGHFPLAERANRGFGIVFSNGKRWKEIRRFSLMTLRNFGMGKRSIEDRVQEEARCLVEELRKTKASPCDPTFILGCAPCNVICSIIFQKRFDYKDQQFLNLMEKLNENIRIVSTPWIQICNNFPTIIDYFPGTHNKLLKNLAFMESDILEKVKEHQESMDINNPRDFIDCFLIKMEKEKQNQQSEFTIENLVITAADLLGAGTETTSTTLRYALLLLLKHPEVTAKVQEEIERVVGRNRSPCMQDRGHMPYTDAVVHEVQRYIDLIPTSLPHAVTCDVKFRNYLIPKGTTILTSLTSVLHDNKEFPNPEMFDPRHFLDEGGNFKKSNYFMPFSAGKRICVGEGLARMELFLFLTFILQNFNLKSLIDPKDLDTTPVVNGFASVPPFYQLCFIPV

SEQ ID NO: 756989 - protein, 440 aa, Homo sapiens
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 756990 - protein, 490 aa, Homo sapiens
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 756991 - protein, 864 aa, Homo sapiens
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAAPKIYGPVFTLYFGLERMVVLHGYEVVKEALIDLGEEFSGRGHFPLAERANRGFGIVFSNGKRWKEIRRFSLMTLRNFGMGKRSIEDRVQEEARCLVEELRKTKASPCDPTFILGCAPCNVICSIIFQKRFDYKDQQFLNLMEKLNENIRIVSTPWIQICNNFPTIIDYFPGTHNKLLKNLAFMESDILEKVKEHQESMDINNPRDFIDCFLIKMEKEKQNQQSEFTIENLVITAADLLGAGTETTSTTLRYALLLLLKHPEVTAKVQEEIERVVGRNRSPCMQDRGHMPYTDAVVHEVQRYIDLIPTSLPHAVTCDVKFRNYLIPKGTTILTSLTSVLHDNKEFPNPEMFDPRHFLDEGGNFKKSNYFMPFSAGKRICVGEGLARMELFLFLTFILQNFNLKSLIDPKDLDTTPVVNGFASVPPFYQLCFIPV

SEQ ID NO: 756992 - protein, 73 aa, Homo sapiens
MLRDHAIRVPEPYGVMRREYQHPPSRGRKNQQHAGTSPCGTALGDPRLPDGPTQVGTPGSQKRDWMEPEGRGS

SEQ ID NO: 756993 - protein, 113 aa, Homo sapiens
TSAPALSPPATLAMRTLTILTAVLLVALQAKAEPLQAEDDPLQAKAYEADAQEQRGANDQDFAVSFAEDASSSLRALGSTRAFTCHCRRSCYSTEYSYGTCTVMGINHRFCCL

SEQ ID NO: 756994 - protein, 74 aa, Homo sapiens
SNPGGKMRPTEEETRVMFEKIAKYIGENLQLLVDRPDGTYCFRLHNDRVYYRRKKGHSYVSSVLWVFPRATRNE

SEQ ID NO: 756995 - protein, 96 aa, Homo sapiens
CGSVQGRRGTRGPQGIPGGLDQMFRLSFCGKMTRGRICGQLCFQCPLGVSKSNKKRINLCHRSFSQFRGLAAHNLENSFGFDQVRKRWEEKVKQQQ

SEQ ID NO: 756996 - protein, 108 aa, Homo sapiens
SEYLPAWGLVGISWDVFAYTHFATESCLLTQGIAHHDPRAPCRTSSQSRQNFCHLRIFLKMRDGDPGNRKLTGTKAVAAEGAATASQALRGYKRKKTCSRLPGLKQTR

SEQ ID NO: 756997 - protein, 694 aa, Homo sapiens [sequence omitted]

SEQ ID NO: 756998 - protein, 127 aa, Homo sapiens
MAPQVPPGEKVEALCMEEEMVRVTQWPFNWRSRCLEYYKNDHAKKPIRIIDLNLCQQVDAGLTFNKKEFENSYIFDINTIDRIFYLVADSEEEMNKWVRCICDICGFNPTEEAWKRRWFVLRSGARM

SEQ ID NO: 756999 - protein, 129 aa, Homo sapiens
MEEEMVRVTQWPFNWRSRCLEYYKNDHAKKPIRIIDLNLCQQVDAGLTFNKKEFENSYIFDINTIDRIFYLVADSEEEMNKWVRCICDICGFNPTEEGKFKILLFNLNSSFLLHFQKCHTILCYFSYTI

SEQ ID NO: 757000 - protein, 118 aa, Homo sapiens
MAPQVPPGEKVEALCMEEEMVRVTQWPFNWRSRCLEYYKNDHAKKPIRIIDLNLCQQVDAGLTFNKKEFENSYIFDINTIDRIFYLVADSEEEMNKWVRCICDICGFNPTEEGSHFVV

SEQ ID NO: 757001 - protein, 190 aa, Homo sapiens
FLFCPLSSQRTESPYKPVHLGLGPTDKVAAIDEFDNAHFTLLGVPNKPLQCLDITATGQKLRNRYHEGKLAPIAPGINRVDWPCFTRAIEDWSHFVSSAGEFKLPCLRKRAEGLSGYAVRYLKPDVTQTWRYCLNQNPSLDRYGQKPLPFDSLNTFRSFGSSYRLECNGLISAHCNLRLPGSSNSPASAF

SEQ ID NO: 757002 - protein, 248 aa, Homo sapiens
FLFCPLSSQRTESPYKPVHLGLGPTDKVAAIAMARIIDLVPWDDGSTHVYASPAILLPMERQRNQLAGVKQQLYHPALPTLRHMDRDTVKACLPDEHCQSTTYCRKDEFDNAHFTLLGVPNKPLQCLDITATGQKLRNRYHEGKLAPIAPGINRVDWPCFTRAIEDWSHFVSSAGEFKLPCLRKRAEGLSGYAVRYLKPDVTQTWRYCLNQNPSLDRYGQKPLPFDSLNTFRSFGSSYSRVNYLTPWH

SEQ ID NO: 757003 - protein, 730 aa, Homo sapiens
ADTHGHTETPDTHIHMHTQMHTHAHTCTETHRCTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEKQPWSDFAVLNGGKINSDIWKDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 757004 - protein, 758 aa, Homo sapiens
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEKQPWSDFAVLNGGKINSDIWKDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 757005 - protein, 758 aa, Homo sapiens; identical to SEQ ID NO: 757004

SEQ ID NO: 757006 - protein, 300 aa, Homo sapiens
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETGTPGEGVASAGTFFFLSFQLLE

SEQ ID NO: 757007 - protein, 472 aa, Homo sapiens
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQFLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 757008 - protein, 1 aa, Homo sapiens
M

SEQ ID NO: 757009 - protein, 505 aa, Homo sapiens
IGMALRAKAEVCMAVPWLSLQRAQALGTRAARVPRTVLPFEAMPQRPGNRWLRLLQIWREQGYEDLHLEVHQTFQELGPIFRYDLGGAGMVCVMLPEDVEKLQQVDSLHPHRMSLEPWVAYRQHRGHKCGVFLLNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYGDNCIQKIYQELAFSRPQQYTSIVAELLLNAELSPDAIKANSMELTAGSVDTTVFPLLMTLFELARNPNVQQALRQESLAAAASISEHPQKATTELPLLRAALKETLRLYPVGLFLERVVSSDLVLQNYHIPAGTLVRVFLYSLGRNPALFPRPERYNPQRWLDIRGSGRNFYHVPFGFGMRQCLGRRLAEAEMLLLLHHVLKHLQVETLTQEDIKMVYSFILRPSMFPLLTFRAIN

SEQ ID NO: 757010 - protein, 505 aa, Homo sapiens; identical to SEQ ID NO: 757009

SEQ ID NO: 757011 - protein, 505 aa, Homo sapiens; identical to SEQ ID NO: 757009

SEQ ID NO: 757012 - protein, 505 aa, Homo sapiens; identical to SEQ ID NO: 757009

SEQ ID NO: 757013 - protein, 505 aa, Homo sapiens; identical to SEQ ID NO: 757009

SEQ ID NO: 757014 - protein, 505 aa, Homo sapiens; identical to SEQ ID NO: 757009

SEQ ID NO: 757015 - protein, 505 aa, Homo sapiens; identical to SEQ ID NO: 757009

SEQ ID NO: 757016 - protein, 505 aa, Homo sapiens; identical to SEQ ID NO: 757009

SEQ ID NO: 757017 - protein, 505 aa, Homo sapiens; identical to SEQ ID NO: 757009

SEQ ID NO: 757018 - protein, 505 aa, Homo sapiens; identical to SEQ ID NO: 757009

SEQ ID NO: 757019 - protein, 505 aa, Homo sapiens; identical to SEQ ID NO: 757009

SEQ ID NO: 757020 - protein, 505 aa, Homo sapiens; identical to SEQ ID NO: 757009

SEQ ID NO: 757021 - protein, 505 aa, Homo sapiens; identical to SEQ ID NO: 757009

SEQ ID NO: 757022 - protein, 537 aa, Homo sapiens
IGMALRAKAEVCMAVPWLSLQRAQALGTRAARVPRTVLPFEAMPQRPGNRWLRLLQIWREQGYEDLHLEVHQTFQELGPIFRYDLGGAGMVCVMLPEDVEKLQQVDSLHPHRMSLEPWVAYRQHRGHKCGVFLLNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYDQHRGGAPVECGTVARCHQGQLYGTHCRERGHGQAGNQPHPERVMPSLPPRHCLPMSHGAHVSHPQAMGPTFLTWDCDVINTFETVFPLLMTLFELARNPNVQQALRQESLAAAASISEHPQKATTELPLLRAALKETLRLYPVGLFLERVVSSDLVLQNYHIPAGTLVRVFLYSLGRNPALFPRPERYNPQRWLDIRGSGRNFYHVPFGFGMRQCLGRRLAEAEMLLLLHHVLKHLQVETLTQEDIKMVYSFILRPSMFPLLTFRAIN

SEQ ID NO: 757023 - protein, 471 aa, Homo sapiens
IGMALRAKAEVCMAVPWLSLQRAQALGTRAARVPRTVLPFEAMPQRPGNRWLRLLQIWREQGYEDLHLEVHQTFQELGPIFRYDLGGAGMVCVMLPEDVEKLQQVDSLHPHRMSLEPWVAYRQHRGHKCGVFLLNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYDQHRGGAPVECGTVARCHQGQLYGTHCRERGHGQAGNQPHPERVMPSLPPRHCLPMSHGAHVSHPQAMGPTFLTWDCDVINTFETVFPLLMTLFELARNPNVQQALRQESLAAAASISEHPQKATTELPLLRAALKETLRLYPVGLFLERVVSSDLVLQNYHIPAGVLKHLQVETLTQEDIKMVYSFILRPSMFPLLTFRAIN

SEQ ID NO: 757024 - protein, 505 aa, Homo sapiens; identical to SEQ ID NO: 757009

SEQ ID NO: 757025 - protein, 505 aa, Homo sapiens; identical to SEQ ID NO: 757009

SEQ ID NO: 757026 - protein, 450 aa, Homo sapiens
IGMALRAKAEVCMAVPWLSLQRAQALGTRAARVPRTVLPFEAMPQRPGNRWLRLLQIWREQGYEDLHLEVHQTFQELGPIFRYDLGGAGMVCVMLPEDVEKLQQVDSLHPHRMSLEPWVAYRQHRGHKCGVFLLNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYDQHRGGAPVECGTVARCHQGQLYGTHCRERGHGQAGNQPHPERVMPSLPPRHCLPMSHGAHVSHPQAMGPTFLTWDCDVINTFETVFPLLMTLFELARNPNVQQALRQESLAAAASISEHPQKATTELPLLRAALKETLRLYPVGLFLERVVSSDLVLQNYHIPAGEIKHVMCFQNTVVGEA

SEQ ID NO: 757027 - protein, 331 aa, Homo sapiens
IGMALRAKAEVCMAVPWLSLQRAQALGTRAARVPRTVLPFEAMPQRPGNRWLRLLQIWREQGYEDLHLEVHQTFQELGPIFRYDLGGAGMVCVMLPEDVEKLQQVDSLHPHRMSLEPWVAYRQHRGHKCGVFLLNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYGDNCIQKIYQELAFSRPQQYTSIVAELLLNAELSPDAIKANSMELTAGSVDTVRPATSPTQRG

SEQ ID NO: 757028 - protein, 698 aa, Homo sapiens
LVQFGTRLDGHTMRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSALCSGQVFTQRSGELSSPEYPRPYPKLSSCTYSISLEEGFSVILDFVESFDVETHPETLCPYDFLKIQTDREEHGPFCGKTLPHRIETKSNTVTITFVTDESGDHTGWKIHYTSTAHACPYPMAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 757029 - protein, 193 aa, Homo sapiens
PGQLDGHTMRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSEQSL

SEQ ID NO: 757030 - protein, 252 aa, Homo sapiens
APALPMRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSGEGGCLGPNAPSPGIPGAPQGHCCSAQGCGGPGPWTLGASRPCCLQLPFSALLPLSAARLISATLP

SEQ ID NO: 757031 - protein, 383 aa, Homo sapiens
MAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 757032 - protein, 202 aa, Homo sapiens
LVQFGTRLDGHTMRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHQTHTTHTHTRQTKKPKHNKTTNTQQTNHQNP

SEQ ID NO: 757033 - protein, 98 aa, Homo sapiens
MIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 757034 - protein, 91 aa, Homo sapiens
LSPVFPFPHAPPFTSVKPQLEEKTNETYGKLEAVQYKTQVVAGTNYYIKVRAGDNKYMHLKVFKSLPGQNEDLVLTGYQVDKNKDDELTGF

SEQ ID NO: 757035 - protein, 98 aa, Homo sapiens; identical to SEQ ID NO: 757033

SEQ ID NO: 757036 - protein, 112 aa, Homo sapiens
MPFLLQQEWSISAKMIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 757037 - protein, 154 aa, Homo sapiens
HHQNGISAQVGLQDATSPIIEELITFHDHALIIIFLICFLPDMPFLLQQEWSISAKMIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 757038 - protein, 171 aa, Homo sapiens
MRVGGTANVTLTGMPRGLLFASWFSRPVRWKPGEHHFWTLRPCRASVISTTQVQQLLPDMPFLLQQEWSISAKMIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 757039 - protein, 150 aa, Homo sapiens
SGFAIDVQRVTGVREEEGGVLEISISLFKPKIGMTLPDMPFLLQQEWSISAKMIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 757040 - protein, 112 aa, Homo sapiens; identical to SEQ ID NO: 757036

SEQ ID NO: 757041 - protein, 112 aa, Homo sapiens; identical to SEQ ID NO: 757036

SEQ ID NO: 757042 - protein, 154 aa, Homo sapiens; identical to SEQ ID NO: 757037

SEQ ID NO: 757043 - protein, 136 aa, Homo sapiens
MRVGGTANVTLTGMPRGLLFASWFSRPVRWKPGEHHFWTLRPCRASVISTTQVQQLLPDMPFLLQQEWSISAKMIPGGLSEAKPATPEIQEIVDKVKPQLEEKTNETYGKLEAVQYKTQVVAGTNYYIKVRVQHLL

SEQ ID NO: 757044 - protein, 302 aa, Homo sapiens
ERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQ

SEQ ID NO: 757045 - protein, 198 aa, Homo sapiens
QHQTNTYTLQYRKHHKVIVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQ

SEQ ID NO: 757046 - protein, 105 aa, Homo sapiens
MNKSPAAKEVFKERIGYTHMLEVLKSLGQPPLELLKELMNMAVEGDHTSVGILGISNVQPLLLLIQWLPELQSHDLQIFISDWLKRICCINRQSRTTCVNANMGI

SEQ ID NO: 757047 - protein, 637 aa, Homo sapiens
MMPFPVTTQGPPQPAPPPNRYGVSSPISLAVPKETDCLLTQRLIETLRPFGVFEEEEELQRRILVLEKLNNLVKEWIREISESKSLPQSVIENVGGKIFTFGSYRLGVHTKGADIDALCVAPSHVDRSDFFTSFYAKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKCHNIYSNILGFLGGVSWAMLVARTCQLYPNAVASTLVRKFFLVFSEWEWPNPVLLKEPEERNLNLPVWDPRVNPSDRYHLMPIITPAYPQQNSTYNVSISTRMVMIEEFKQGLAITHEILLSKAEWSKLFEAPSFFQKYKHYIVLLASASTEKQHLEWVGLVESKIRILVGSLEKNEFITLAHVNPQSFPAPKENPDMEEFRTMWVIGLGLKKPDNSEILSIDLTYDIQSFTDTVYRQAVNSKMFEMGMKITAMHLRRKELHQLLPHHVLQDKKAHSTEGRRLTDLNDSSFDLSAGCENSMSVPSSTSTMKTGPLISSSQGRNSPALAVMTASVANIQATEFSLQQVNTNESSGVALNESIPHAVSQPAISPSPKAMVARVVSSTCLISHPDLQETQQQTYLIL

SEQ ID NO: 757048 - protein, 1374 aa, Homo sapiens
NSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLRLVKFLINLPIVSSVTHMLVHTTLHGVLALGARVLSLVVEGINNEMFTAWQKMEAIKKVITVSTWLSHMGTESAEEEDAPNGKLVLCLLSALCPVAEAYSRGMWAVRSEHTK

SEQ ID NO: 757049 - protein, 1780 aa, Homo sapiens
NSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVGAVSGPTVNGFQICRLVKFLINLPIVSSVTHMLVHTTLHGVLALGARVLSLVVEGINNEMFTAWQKMEAIKKVITVSTWLSHMGTESAEEEDAPNGKLVLCLLSAAVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 757050 - protein, 1374 aa, Homo sapiens; identical to SEQ ID NO: 757048

SEQ ID NO: 757051 - protein, 1780 aa, Homo sapiens; identical to SEQ ID NO: 757049

SEQ ID NO: 757052 - protein, 256 aa, Homo sapiens
PRLSPRVCRLGEVPHPERAANGPAPSAQTLLSAAPGSGSAARCFRPGCRGPGCTLSARLRPPEAPAGVRAASGPAETERLEDEAAAAGRRMGANQLVVLNVYDMGLTQSLRLECSVTITAHCSLDLLGSELVPSDGFLVSLTSRMKPQTLVYWMNEYTSSIGIGVFHSGIEVYGREFAYGGHPYPFSGIFEISPGNASELGETFKFKEAVVLGSTDFLEDDIEKIVEELGKEYKGNAYHLMHKNCNHFSSALSEVS

SEQ ID NO: 757053 - protein, 247 aa, Homo sapiens
PRLSPRVCRLGEVPHPERAANGPAPSAQTLLSAAPGSGSAARCFRPGCRGPGCTLSARLRPPEAPAGVRAASGPAETERLEDEAAAAGRRMGANQLVVLNVYDMYWMNEYTSSIGIGVFHSGIEVYGREFAYGGHPYPFSGIFEISPGNASELGETFKFKEAVVLGSTDFLEDDIEKIVEELGKEYKGNAYHLMHKNCNHFSSALSEILCGKEIPRWINRLAYFSSCIPFLQSCLPKEVAHARSPAV

SEQ ID NO: 757054 - protein, 174 aa, Homo sapiens
MRLTFLKKIAQLNYLEILVVLLSYTLKTTFQYWMNEYTSSIGIGVFHSGIEVYGREFAYGGHPYPFSGIFEISPGNASELGETFKFKEAVVLGSTDFLEDDIEKIVEELGKEYKGNAYHLMHKNCNHFSSALSEILCGKEIPRWINRLAYFSSCIPFLQSCLPKEVAHARSPAV

SEQ ID NO: 757055 - protein, 247 aa, Homo sapiens; identical to SEQ ID NO: 757053

SEQ ID NO: 757056 - protein, 247 aa, Homo sapiens; identical to SEQ ID NO: 757053

SEQ ID NO: 757057 - protein, 133 aa, Homo sapiens
PRLSPRVCRLGEVPHPERAANGPAPSAQTLLSAAPGSGSAARCFRPGCRGPGCTLSARLRPPEAPAGVRAASGPAETERLEDEAAAAGRRMGANQLVVLNVYDMYWMNEYTSSIGIGVFHSGIEVYGREKLLF

SEQ ID NO: 757058 - protein, 247 aa, Homo sapiens; identical to SEQ ID NO: 757053

SEQ ID NO: 757059 - protein, 113 aa, Homo sapiens
IQNSFSSVDSLWERDSSLDQSTCLLQLLYTLSTELPPEGGGSRPQPCSLVSAKNSRMNWRKQRMLPHPLPWQALQQAPDPGATLNYKCLQSHTFRTVSGSRISLEKSKQRSIL

SEQ ID NO: 757060 - protein, 247 aa, Homo sapiens; identical to SEQ ID NO: 757053

SEQ ID NO: 757061 - protein, 2413 aa, Homo sapiens
MGISTVILEMCLLWGQVLSTGGWIPRTTDYASLIPSEVPLDPTVAEGSPFPSESTLESTAAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGSESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 757062 - protein, 2403 aa, Homo sapiens
MGISTVILEMCLLWGQVLSTGGWIPRTTDYASLIPSEVPLDPTVAEGSPFPSESTLESTAAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGSESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 757063 - protein, 1785 aa, Homo sapiens
MGISTVILEMCLLWGQVLSTGGWIPRTTDYASLIPSEVPLDPTVAEGSPFPSESTLESTAAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 757064 - protein, 2311 aa, Homo sapiens
MGISTVILEMCLLWGQVLSTGGWIPRTTDYASLIPSEVPLDPTVAEGSPFPSESTLESTAAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGSESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTLRLSPTLCCTWSYGVESDLVPASPKAHGPWRTRCRARSREF

SEQ ID NO: 757065 - protein, 2296 aa, Homo sapiens
MGISTVILEMCLLWGQVLSTGGWIPRTTDYASLIPSEVPLDPTVAEGSPFPSESTLESTAAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGSESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTPPPPRLMVLGGPVAGRGQESSDLDGP

SEQ ID NO: 757066 - protein, 110 aa, Homo sapiens
GNYNVSNLKQGPAYQLIEIKYASFKKFGPQGQKFARGASVGGRSQTPLSTGAQTPDSGTWDVPLGVIFQLRLSPTLCCTWSYGVESDLVPASPKAHGPWRTRCRARSREF

SEQ ID NO: 757067 - protein, 172 aa, Homo sapiens
GGKKEREKGGRVASRGLGRHPHAPKRARPPRGAPGRRPRPSAAPRWPRPRTPRPARRGPAPSGIMAQVAVSTLPVEEESSSETRMVVTFLVSALESMCKELAKSKAEVACIAVYETDVFVVGTERGCAFVNARTDFQKDFAKYCRCFNFILCIPNLKRIAGKTSTVFSSKLS

SEQ ID NO: 757068 - protein, 111 aa, Homo sapiens
MAPKHKSSDAGNLDRPKRSRKVLPLSEKVKVLDLIRKDKKSYAEVAKIYGKNESSIREIVKKEKEIRASFAVSPPTAKVTATVRDKCLVKMEQALHLWVEEMNRKRVPIDS

SEQ ID NO: 757069 - protein, 111 aa, Homo sapiens; identical to SEQ ID NO: 757068

SEQ ID NO: 757070 - protein, 122 aa, Homo sapiens
SVQRAGFRVTYWPVASISHDGMQVHSGETEILRKAVEDYFCFCYGKALGTTVMVPVPYEKMLRDQSAVVVQGLPEGVAFQHPENYDLATLKWILENKAGISFIINRWPWDGNRCGEIHSITK

SEQ ID NO: 757071 - protein, 55 aa, Homo sapiens
MVTDAERSIVSPSESCGPINVKTEPMEDSGISLKAEAVSVKKESEDPNYYQYNMQ

SEQ ID NO: 757072 - protein, 320 aa, Homo sapiens
GGKKEREKGGRVASRGLGRHPHAPKRARPPRGAPGRRPRPSAAPRWPRPRTPRPARRGPAPSGIMAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSESCGPINVKTEPMEDSGGYQDAFRIKYRPSVVAHACNPSNLGGRGRRIT

SEQ ID NO: 757073 - protein, 313 aa, Homo sapiens
GGKKEREKGGRVASRGLGRHPHAPKRARPPRGAPGRRPRPSAAPRWPRPRTPRPARRGPAPSGIMAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSESCGPINVKTEPMEDSGISLKAEAVSVKKESEDPNYYQYNMQ

SEQ ID NO: 757074 - protein, 121 aa, Homo sapiens
GGKKEREKGGRVASRGLGRHPHAPKRARPPRGAPGRRPRPSAAPRWPRPRTPRPARRGPAPSGIMAQVAVSTLPVEEESSSETRMVVTFLVSALESMRSGLHRSVRNRRVCRRNRERMRFC

SEQ ID NO: 757075 - protein, 172 aa, Homo sapiens; identical to SEQ ID NO: 757067

SEQ ID NO: 757076 - protein, 534 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 757077 - protein, 534 aa, Homo sapiens; identical to SEQ ID NO: 757076

SEQ ID NO: 757078 - protein, 534 aa, Homo sapiens; identical to SEQ ID NO: 757076

SEQ ID NO: 757079 - protein, 589 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGEQRGPTHKSEGVSGLPGANFPRGGAEEAHLAPWLVGGELDDPTLLTNFSSPPLPGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 757080 - protein, 570 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQGKAGFPTPEPTEAPFSGASYMPVPICIIQSTPVLPAAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 757081 - protein, 562 aa, Homo sapiens
LTADGRRAIVSPWHVVPVKPLVVRMNARMVLCAAGCLLAADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 757082 - protein, 494 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKGW

SEQ ID NO: 757083 - protein, 534 aa, Homo sapiens; identical to SEQ ID NO: 757076

SEQ ID NO: 757084 - protein, 523 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEFAKEMAEDDDDSFP

SEQ ID NO: 757085 - protein, 289 aa, Homo sapiens
NQARYEAWVVGNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 757086 - protein, 520 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAENDLGGKPHVRT

SEQ ID NO: 757087 - protein, 518 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKVRSPWLQSHAWQQHTPPPPERAAGIR

SEQ ID NO: 757088 - protein, 490 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRPWIGHSPYYKV

SEQ ID NO: 757089 - protein, 525 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMNFPTHSSYAAFVQGVGVLGASHPDLPQGSSPAGDLLYSRQEGGQATSPGRVLASSVGAGGEG

SEQ ID NO: 757090 - protein, 170 aa, Homo sapiens
SLGGAWRGSWGGSIGRRFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 757091 - protein, 466 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMREG

SEQ ID NO: 757092 - protein, 97 aa, Homo sapiens
LGLESFQRIPVASINHEKGYVQSKEMIDIYSTREPQLAFHQRISFCLDIHNMSVKAMRFPPKSYNKDLESAEERREREQQDLEFAKEMAEDDDDSFP

SEQ ID NO: 757093 - protein, 142 aa, Homo sapiens
SCNLGRGHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 757094 - protein, 539 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQGKAGFPTPEPTEAPFSGASYMPVPICIIQSTPVLPAAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRGRIVLCTPLGSGGLELGCLGLYVF

SEQ ID NO: 757095 - protein, 304 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIQEAIPGLEG

SEQ ID NO: 757096 - protein, 265 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATSPGRVLASSVGAGGEG

SEQ ID NO: 757097 - protein, 136 aa, Homo sapiens
PSSQPTGCRPGPSHMESSTGKASPRCHIHCVPPFPPPCPVKRVGRLFLFFQHFPQGTVIIPLMPTHRGDAGSAGCVSASPASFPRSSPLFAVPQAMRFPPKSYNKDLESAEERREREQQDLEFAKEMAEDDDDSFP

SEQ ID NO: 757098 - protein, 188 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEVSRMQ

SEQ ID NO: 757099 - protein, 116 aa, Homo sapiens
LCLKFPEASLFKHQSSVSQVLGLANVKAISSLGQKLPTLMGSSCCMVECPLSQPTACPGISKGSCQVCVTPTQKVKLAFEPRGLALWMCITSKGKEMTSFWLRGLARGLRSSDYLD

SEQ ID NO: 757100 - protein, 207 aa, Homo sapiens
MIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAP

SEQ ID NO: 757101 - protein, 648 aa, Homo sapiens
ITSLPPSSLTMNRQVCKKSFSGRSQGFSGRSAVVSGSSRMSCVARSGGAGGGACGFRSGAGSFGSRSLYNLGSNKSISISVAAGSSRAGGFGGGRSSCGFAGGYGGGFGGSYGGGFGGGRGVGSGFGGAGGFGGAGGFGGPGVFGGPGSFGGPGGFGPGGFPGGIQEVIVNQSLLQPLNVEIDPQIGQVKAQEREQIKTLNNKFASFIDKVRFLEQQNKVLETKWELLQQQTTGSGPSSLEPCFESYISFLCKQLDSLLGERGNLEGELKSMQDLVEDFKKKYEDEINKRTAAENEFVGLKKDVDAAFMNKVELQAKVDSLTDEVSFLRTLYEMELSQMQSHASDTSVVLSMDNNRCLDLGSIIAEVRTQYEEIAQRSKSEAEALYQTKLGELQTTAGRHGDDLRNTKSEIMELNRMIQRLRAEIENVKKQNANLQTAIAEAEQRGEMALKDANAKLQDLQTALQKAKDDLARLLRDYQELMNVKLALDVEIATYRKLLEGEECRMSGECQSAVCISVVSNVTSTSGSSGSSRGVFGGVSGSGSGGYKGGSSSSSSSGYGVSGGSGSGYGGVSSGSTGGRGSSGSYQSSSSGSRLGGAGSISVSHSGMGSSSGSIQTSGGSGYKSGGGGSTSIRFSQTTSSSQHSSTK

SEQ ID NO: 757102 - protein, 169 aa, Homo sapiens
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPAPTECFARVSCSGVEALGRRDWLGGGPRATDGHRGQCPKGEPRVVTTATPSKSAGNGKFSG

SEQ ID NO: 757103 - protein, 169 aa, Homo sapiens; identical to SEQ ID NO: 757102

SEQ ID NO: 757104 - protein, 123 aa, Homo sapiens
MNKPVVDGNSQSEALSLEMRKDPSGAGLWLHSGGPVLPYVRESVRRNPASAATPSTAVGLFPAPTECFARVSCSGVEALGRRDWLGGGPRATDGHRGQCPKGEPRVVTTATPSKSAGNGKFSG

SEQ ID NO: 757105 - protein, 169 aa, Homo sapiens; identical to SEQ ID NO: 757102

SEQ ID NO: 757106 - protein, 73 aa, Homo sapiens
HTFSVGIMAIMNMSHCCRDFVYGQFWGQFMARFGGLFPTLPCYTSSSSTFLYKLSEIQSGIFLTEAYNLTIFS

SEQ ID NO: 757107 - protein, 36 aa, Homo sapiens
SSTYSSQKPWKHLIPPTLHTIPSDSSGSSNFAQILP

SEQ ID NO: 757108 - protein, 71 aa, Homo sapiens
KMLKMYQSSKKAKEGTEDASPTKQKSPISFFQCVYLDGYNGYGFQFPFTPADRPGESSGQANSPGQKQQGQ

SEQ ID NO: 757109 - protein, 71 aa, Homo sapiens; identical to SEQ ID NO: 757108

SEQ ID NO: 757110 - protein, 80 aa, Homo sapiens
QRDQPACWLAGVMSLGLKKLLASREHGAVVSESVMGAAHQDGNQARPRPCGLSSVEGERLQAPDFTTGWPTVASGPNKDV

SEQ ID NO: 757111 - protein, 1159 aa, Homo sapiens
WPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTGNVDFMSLVQGELYFTPCIYTFCY

SEQ ID NO: 757112 - protein, 1252 aa, Homo sapiens
MTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 757113 - protein, 1252 aa, Homo sapiens; identical to SEQ ID NO: 757112

SEQ ID NO: 757114 - protein, 1252 aa, Homo sapiens; identical to SEQ ID NO: 757112

SEQ ID NO: 757115 - protein, 1240 aa, Homo sapiens
MTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEVW

SEQ ID NO: 757116 - protein, 31 aa, Homo sapiens
IRSFDKDPLSGPIFRDSNRSGVCTGTGVFKI

SEQ ID NO: 757117 - protein, 154 aa, Homo sapiens
AERVWLHLHRYLSADRRVLGLREWGRPASERECSLCQRLKRELNMGDVEKGKKIFIMKCSQCHTVEHREASTRLGQNLHGLFGAEDRSGPWILLHSRQIRTKGHSSWGEGYTGWSIWENSPRRYNSPGNQKMIFVGIKKKEERADLIGLSQKSY

SEQ ID NO: 757118 - protein, 110 aa, Homo sapiens
MGDVEKGKKIFIMKCSQCHTVEHREASTRLGQNLHGLFGAEDRSGPWILLHSRQIRTKGHSSWGEGYTGWSIWENSPRRYNSPGNQKMIFVGIKKKEERADLIGLSQKSY

SEQ ID NO: 757119 - protein, 122 aa, Homo sapiens
HAVHPNMLASMRAQVLGAGIGTGANEVRRRYCVAPARPHVRAREAERVWLHLHRYLSADRRVLGLREWGRPASERECSLCQRLKRGESGSRRPHLVRGRAVGGAHLRATETQAGSIRVEPAL

SEQ ID NO: 757120 - protein, 110 aa, Homo sapiens; identical to SEQ ID NO: 757118

SEQ ID NO: 757121 - protein, 103 aa, Homo sapiens
SAPRVSTVGLLCSGAGPHLCPCAEEGTGGLESQGEIIPSRGSRKWPDGVSGSRRLFSSLCKSQEGSRKECLRKHRRLGPAMPVSSPGFPGPYGSFGTPPGYGC

SEQ ID NO: 757122 - protein, 55 aa, Homo sapiens
SAPRVSTVGLLCSGAGPHLCPCAEEGTGGLESQGEIIPSRGSRKMARSEHHLDTA

SEQ ID NO: 757123 - protein, 120 aa, Homo sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLASWLGITKDLRNDEHTRRELSQDEAGSR

SEQ ID NO: 757124 - protein, 111 aa, Homo sapiens
MAAIRKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNNEGSSE

SEQ ID NO: 757125 - protein, 123 aa, Homo sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNNEGSSE

SEQ ID NO: 757126 - protein, 123 aa, Homo sapiens; identical to SEQ ID NO: 757125

SEQ ID NO: 757127 - protein, 123 aa, Homo sapiens; identical to SEQ ID NO: 757125

SEQ ID NO: 757128 - protein, 123 aa, Homo sapiens; identical to SEQ ID NO: 757125

SEQ ID NO: 757129 - protein, 123 aa, Homo sapiens; identical to SEQ ID NO: 757125

SEQ ID NO: 757130 - protein, 123 aa, Homo sapiens; identical to SEQ ID NO: 757125

SEQ ID NO: 757131 - protein, 123 aa, Homo sapiens; identical to SEQ ID NO: 757125

SEQ ID NO: 757132 - protein, 123 aa, Homo sapiens; identical to SEQ ID NO: 757125

SEQ ID NO: 757133 - protein, 123 aa, Homo sapiens; identical to SEQ ID NO: 757125

SEQ ID NO: 757134 - protein, 123 aa, Homo sapiens; identical to SEQ ID NO: 757125

SEQ ID NO: 757135 - protein, 120 aa, Homo sapiens; identical to SEQ ID NO: 757123

SEQ ID NO: 757136 - protein, 155 aa, Homo sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHEPVKPGKKGRDMANRIGAFGYMAVFTQRPKDGVDERRFLKLATKKLLCKA

SEQ ID NO: 757137 - protein, 77 aa, Homo sapiens
LRVTISSPPFAHRNRYTEVTLLLTTAQEPVKPGKKGRDMANRIGAFGYMAVFTQRPKDGVDERRFLKLATKKLLCKA

SEQ ID NO: 757138 - protein, 123 aa, Homo sapiens; identical to SEQ ID NO: 757125

SEQ ID NO: 757139 - protein, 109 aa, Homo sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLDGRRFLKLATKKLLCKA

SEQ ID NO: 757140 - protein, 123 aa, Homo sapiens; identical to SEQ ID NO: 757125

SEQ ID NO: 757141 - protein, 123 aa, Homo sapiens; identical to SEQ ID NO: 757125

SEQ ID NO: 757142 - protein, 123 aa, Homo sapiens; identical to SEQ ID NO: 757125

SEQ ID NO: 757143 - protein, 123 aa, Homo sapiens; identical to SEQ ID NO: 757125

SEQ ID NO: 757144 - protein, 99 aa, Homo sapiens
RTGPHRSTGPNSSLKYTANSPARPPLMPRVATSRPVQLACRPWDEKVYGLLFLLVCQQAPATNRIGAFGYMAVFTQRPKDGVDERRFLKLATKKLLCKA

SEQ ID NO: 757145 - protein, 150 aa, Homo sapiens
ARYSSGRQAAAPPRPRPTGCSWPSRPWPLTLDLTPSPGPAPQAATPPAQSPEARPVVSCAPSPARPGLVEPRLPACPPSVPGASSPSSAGQGGGFGPGPATAQCSRPLKARVAVGVEMGKKLFTTPFCFLRLTRNDNHCFILIKVQLHFG

SEQ ID NO: 757146 - protein, 123 aa, Homo sapiens; identical to SEQ ID NO: 757125

SEQ ID NO: 757147 - protein, 123 aa, Homo sapiens; identical to SEQ ID NO: 757125

SEQ ID NO: 757148 - protein, 123 aa, Homo sapiens; identical to SEQ ID NO: 757125

SEQ ID NO: 757149 - protein, 123 aa, Homo sapiens; identical to SEQ ID NO: 757125

SEQ ID NO: 757150 - protein, 123 aa, Homo sapiens; identical to SEQ ID NO: 757125

SEQ ID NO: 757151 - protein, 123 aa, Homo sapiens; identical to SEQ ID NO: 757125

SEQ ID NO: 757152 - protein, 123 aa, Homo sapiens; identical to SEQ ID NO: 757125

SEQ ID NO: 757153 - protein, 123 aa, Homo sapiens; identical to SEQ ID NO: 757125

SEQ ID NO: 757154 - protein, 88 aa, Homo sapiens
PHHPLSPLRPLTKSRYEAWVFRPRSLALPSRRPRSSVGSLVSPRSGLQLPAFVSEFATRGPASPARRGWTRIRCLSNGCHPEETGDCW

SEQ ID NO: 757155 - protein, 123 aa, Homo sapiens; identical to SEQ ID NO: 757125

SEQ ID NO: 757156 - protein, 123 aa, Homo sapiens; identical to SEQ ID NO: 757125

SEQ ID NO: 757157 - protein, 102 aa, Homo sapiens
MAAIRKKLVIVGDGACGKTCLLIVFSKDQFPEVYVPTVFENYVADIEVDGKQEPVKPGKKGRDMANRIGAFGYMAVFTQRPKDGVDERRFLKLATKKLLCKA

SEQ ID NO: 757158 - protein, 123 aa, Homo sapiens; identical to SEQ ID NO: 757125

SEQ ID NO: 757159 - protein, 123 aa, Homo sapiens; identical to SEQ ID NO: 757125

SEQ ID NO: 757160 - protein, 123 aa, Homo sapiens; identical to SEQ ID NO: 757125

SEQ ID NO: 757161 - protein, 123 aa, Homo sapiens; identical to SEQ ID NO: 757125

SEQ ID NO: 757162 - protein, 123 aa, Homo sapiens; identical to SEQ ID NO: 757125

SEQ ID NO: 757163 - protein, 126 aa, Homo sapiens
MLADLPCRAKNASTCNCPSITSAWLFAEGNQRRKFSPTAPTQLMEQSPTWHSPKLGSDATYFQNTGKILKPAGELSGPACTHSSTPQAFVPGSPGMMGSQGAQGQRRQTHSCRVPENGGWPGIRAA

SEQ ID NO: 757164 - protein, 568 aa, Homo sapiens
SPIGAARFASAAQPPAQVALWTLQPRSEAAGRLRDHGGRSLGLRAMAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757165 - protein, 508 aa, Homo sapiens
MKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757166 - protein, 544 aa, Homo sapiens
MPTQQPAAPSTRAPKPSRSLSGSLCALFSDADSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757167 - protein, 529 aa, Homo sapiens
HASPTRRAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757168 - protein, 523 aa, Homo sapiens
MAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757169 - protein, 631 aa, Homo sapiens
SPIGAARFASAAQPPAQVALWTLQPRSEAAGRLRDHGGRSLGLRAMAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVGSGFGAWLERAWEMDWREERCWVQSEKDRCLGQSSLTVHFLSSFIPSFLNSGPLVLFPCFVKVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757170 - protein, 317 aa, Homo sapiens
MVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757171 - protein, 529 aa, Homo sapiens; identical to SEQ ID NO: 757167

SEQ ID NO: 757172 - protein, 370 aa, Homo sapiens
HASPTRRAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGWYGPDLVTEQIGSWNDLKKGLPTCLWE

SEQ ID NO: 757173 - protein, 334 aa, Homo sapiens
HASPTRRAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEVMSMRNKEGMHLWVKLRNMLKTPGKANVSLFLP

SEQ ID NO: 757174 - protein, 497 aa, Homo sapiens
HASPTRRAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757175 - protein, 514 aa, Homo sapiens
MAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757176 - protein, 267 aa, Homo sapiens
HASPTRRAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMR

SEQ ID NO: 757177 - protein, 529 aa, Homo sapiens; identical to SEQ ID NO: 757167

SEQ ID NO: 757178 - protein, 529 aa, Homo sapiens; identical to SEQ ID NO: 757167

SEQ ID NO: 757179 - protein, 317 aa, Homo sapiens; identical to SEQ ID NO: 757170

SEQ ID NO: 757180 - protein, 332 aa, Homo sapiens
MPTQQPAAPSTRAPKPSRSLSGSLCALFSDADSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVCPILFSLMIQPHLPQYYPSFCHPRSSLGDRGNTPTLRTFSSVKLTPSPRSEIFIKGYFADHLVYPIGDSGLHNTA

SEQ ID NO: 757181 - protein, 332 aa, Homo sapiens; identical to SEQ ID NO: 757180

SEQ ID NO: 757182 - protein, 295 aa, Homo sapiens
GRVGPDAWVRTRGSGRVGRPTRPLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757183 - protein, 418 aa, Homo sapiens
HASPTRRAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSTEEKDSKVGGEKV

SEQ ID NO: 757184 - protein, 267 aa, Homo sapiens; identical to SEQ ID NO: 757176

SEQ ID NO: 757185 - protein, 125 aa, Homo sapiens
RESSRYRHVLLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 757186 - protein, 168 aa, Homo sapiens
MPTQQPAAPSTRAPKPSRSLSGSLCALFSDADSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSALRLGSSL

SEQ ID NO: 757187 - protein, 154 aa, Homo sapiens
MPTQQPAAPSTRAPKPSRSLSGSLCALFSDADSGSGMKAELPPGPGAVGREMTKEEKLQLRKEKKQQKKKRKEEKGAEPETGSAVSAAQCQVGPTRELPESGIQLGTPREKVPAGRSKAELRAERRPIMYQCWFAVKHTSSVSVCRLMPLSLMS

SEQ ID NO: 757188 - protein, 151 aa, Homo sapiens [sequence omitted]

SEQ ID NO: 757189 - protein, 144 aa, Homo sapiens
MSPPSPLTALAGRGVAVVAVCEQDSSKYFLLINCLHVKNCKTKKKKTGGGGKNPGRFPGFADPSGADGGNPPLKGVLIASFAQEKEGSPQGTSQASRPGGPKLKPGGHSEIPGLPHVVIRAGPGGPKPTPENQGGHHRAHFANH

SEQ ID NO: 757190 - protein, 96 aa, Homo sapiens
EFKLLTMYGDMSLIFLGKGETICRVTGGMKVKADRDESSPYAAMLAAPGMWPRGARSWGITALHIKLRATGGKLGPRPLGTLGPSSALRSPCPLGY

SEQ ID NO: 757191 - protein, 68 aa, Homo sapiens
PAAATTTTKFAAASTLETRTKTPGDPGAQFGPQEPLPARVLKIGRIEDVTPIPSDSTRRKGGRRGRRL

SEQ ID NO: 757192 - protein, 83 aa, Homo sapiens
PLSLSGVESGDDVQVGGPGATIGGHPAARGPCGAWDERRGSFRGNRARCRARDARLAHLDPGQLGIEFVPGLRRPVLLSGRSL

SEQ ID NO: 757193 - protein, 83 aa, Homo sapiens; identical to SEQ ID NO: 757192

SEQ ID NO: 757194 - protein, 151 aa, Homo sapiens [sequence omitted]

SEQ ID NO: 757195 - protein, 151 aa, Homo sapiens [sequence omitted]

SEQ ID NO: 757196 - protein, 151 aa, Homo sapiens [sequence omitted]

SEQ ID NO: 757197 - protein, 151 aa, Homo sapiens [sequence omitted]

SEQ ID NO: 757198 - protein, 151 aa, Homo sapiens [sequence omitted]

SEQ ID NO: 757199 - protein, 151 aa, Homo sapiens [sequence omitted]

SEQ ID NO: 757200 - protein, 151 aa, Homo sapiens [sequence omitted]

SEQ ID NO: 757201 - protein, 151 aa, Homo sapiens [sequence omitted]

SEQ ID NO: 757202 - protein, 83 aa, Homo sapiens; identical to SEQ ID NO: 757192

SEQ ID NO: 757203 - protein, 110 aa, Homo sapiens
ERRISLEKDGLDLEIPSMTTGLPANQSILTPTFTEMELVTLLGSRSRRTAAVEMRPSAAGRRSGDGPPPSCRIRHEEDQDPWGPWGPVRPSGALARSGIEDRADWVSAPL

SEQ ID NO: 757204 - protein, 100 aa, Homo sapiens
LRPLLLLLNSRPRRPGDACYVGCPRDVAQRCKELGYHRPTHQTPGHRREIRTKTPGDPGAQFGPQEPLPARVLKIGRIEDVTPIPSDSTRRKGGRRGRRL

SEQ ID NO: 757205 - protein, 77 aa, Homo sapiens
VESGDDVQVGGPGATIGGHPAARGPCGAWDERRGSFRGNRARCRARDARLAHLDPGQLGIEFVPGLRRPVLLSGRSL

SEQ ID NO: 757206 - protein, 89 aa, Homo sapiens
SAESLKKKIGLDLEIPSMTTGLPANQSILTPTFTEMELVTLLGSRSRRTAAVEMRPSAAGRRSGDGPPPSCRIRHEELHPSNDTFVPCH

SEQ ID NO: 757207 - protein, 103 aa, Homo sapiens
LSITVSGRGSIAPSEHVQMDLRERKNVPRTSGVEIFGLPLHLHDTFRTIFGKETISVTGDGRQTEMNPHHMLLCWLPQGCGPEVQGAGVSPPYTSNSGPQEGN

SEQ ID NO: 757208 - protein, 83 aa, Homo sapiens; identical to SEQ ID NO: 757192

SEQ ID NO: 757209 - protein, 96 aa, Homo sapiens; identical to SEQ ID NO: 757190

SEQ ID NO: 757210 - protein, 104 aa, Homo sapiens
MRVFRNLAGGGARGPQGGRGNNVGRKAGGPSRRETAGTRETKGGGGSPHHNIKKPRPGGRHRDERRLGEQKSPERGGPGGGTLKGGALYQQGRRPKENAPKSQN

SEQ ID NO: 757211 - protein, 151 aa, Homo sapiens [sequence omitted]

SEQ ID NO: 757212 - protein, 151 aa, Homo sapiens [sequence omitted]

SEQ ID NO: 757213 - protein, 151 aa, Homo sapiens [sequence omitted]

SEQ ID NO: 757214 - protein, 151 aa, Homo sapiens [sequence omitted]

SEQ ID NO: 757215 - protein, 151 aa, Homo sapiens [sequence omitted]

SEQ ID NO: 757216 - protein, 151 aa, Homo sapiens [sequence omitted]

SEQ ID NO: 757217 - protein, 151 aa, Homo sapiens [sequence omitted]

SEQ ID NO: 757218 - protein, 151 aa, Homo sapiens [sequence omitted]

SEQ ID NO: 757219 - protein, 735 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 757220 - protein, 735 aa, Homo sapiens; identical to SEQ ID NO: 757219

SEQ ID NO: 757221 - protein, 796 aa, Homo sapiens
PAAAASAWPVPSSPARAPAPAPALQLRPRALSSKAYPLKRSKQRKYYYEAAFLAILEKNRQMAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 757222 - protein, 735 aa, Homo sapiens; identical to SEQ ID NO: 757219

SEQ ID NO: 757223 - protein, 783 aa, Homo sapiens
VAVLEVPVLCWVGKEELTAGAAYPLKRSKQRKYYYEAAFLAILEKNRQMAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 757224 - protein, 783 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVSDLMPPPPTSPTSWPWPWPLAHCCPQPLPPLGPAQTLPDKELPFFPKVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 757225 - protein, 735 aa, Homo sapiens; identical to SEQ ID NO: 757219

SEQ ID NO: 757226 - protein, 718 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTRSTNFFGFLS

SEQ ID NO: 757227 - protein, 737 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTVSIDDPSQKLNPWDSMDPKSPFHSFFTPF

SEQ ID NO: 757228 - protein, 427 aa, Homo sapiens
QKFKPPPRSMVARLGLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 757229 - protein, 342 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVSDLMPPPPTSPTSWPWPWPLAHCCPQPLPPLGPAQTLPDKELPFSPRSNHMCGCEEAVSPGAATAVRKRSGSTTV

SEQ ID NO: 757230 - protein, 147 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSVSWGPCMLGKGICV

SEQ ID NO: 757231 - protein, 77 aa, Homo sapiens
AKILKDLEMSKVVHMDRWSVEVIPQQTEEKSDPVPFQIINNYFSIGVVSGMGPGEKGERGGQAVRGWRRAEKEGEVK

SEQ ID NO: 757232 - protein, 160 aa, Homo sapiens
PRCGRVCLARPLQPSSGSSSSAGASAATASPLKQGRDPASPPAPHPPPSEKDRGREAEDPRAAFVLLGREGGSVTAGAGIEKGLRWDAGVQREGWARTRWVTFPRPSPPSLPLIRRDGEARFLGPDSEGSPLRNLHSAARVEKGSCLASRSPTSHPILSP

SEQ ID NO: 757233 - protein, 735 aa, Homo sapiens; identical to SEQ ID NO: 757219

SEQ ID NO: 757234 - protein, 735 aa, Homo sapiens; identical to SEQ ID NO: 757219

SEQ ID NO: 757235 - protein, 815 aa, Homo sapiens
PAAAASAWPVPSSPARAPAPAPALQLRPRALSSKVETPRAPQRPTLPHRKRTGAYPLKRSKQRKYYYEAAFLAILEKNRQMAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 757236 - protein, 737 aa, Homo sapiens; identical to SEQ ID NO: 757227

SEQ ID NO: 757237 - protein, 583 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRLGKGGGSVGIHSVRSQVLTKFDSDCSEEQWHL

SEQ ID NO: 757238 - protein, 357 aa, Homo sapiens
LFVNPKWGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 757239 - protein, 425 aa, Homo sapiens
NETKIRLGRRLGVLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 757240 - protein, 128 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKGMVKQVGCSFTLTVFIILHHLTVPHAHTHTHTPKHIH

SEQ ID NO: 757241 - protein, 58 aa, Homo sapiens
MASHSGITGPGASGVLGIILSHQEDSGSTTPRVGSAGLQGWSQGGQGCVMYALTASFS

SEQ ID NO: 757242 - protein, 445 aa, Homo sapiens
MCVRRSLVGLTFCTCYLASYLTNKYVLSVLKFTYPTLFQGWQTLIGGLLLHVSWKLGWVEINSSSRSHVLVWLPASVLFVGIIYAGSRALSRLAIPVFLTLHNVAEVIICGYQKCFQKEKTSPAKICSALFLLAAAGCLPFNDSQFNPDGYFWAIIHLLCVGAYKILQKSQKPSALSDIDQQYLNYIFSVVLLAFASHPTGDLFSVLDFPFLYFYRFHGSCCASGFLGFFLMFSTVKLKNLLAPGQCAAWIFFAKIITAGLSILLFDAILTSATTGCLLLGALGEALLVFSELEELLNKTVKRKTHRLLRENSLYTCVRAPGLIAPCWMCQKEECKDSEARWAVHHLTQVNVVVADEAEAWCFKEHLSGGLQVTAEEAVCYIFFHLENLSQRAVAGSAETRKYQDFMGWSGRSMSFNFWMANALSQKLVSVKGMGKGWGVIPRKT

SEQ ID NO: 757243 - protein, 410 aa, Homo sapiens
MCVRRSLVGLTFCTCYLASYLTNKYVLSVLKFTYPTLFQGWQTLIGGLLLHVSWKLGWVEINSSSRSHVLVWLPASVLFVGIIYAGSRALSRLAIPVFLTLHNVAEVIICGYQKCFQKEKTSPAKICSALFLLAAAGCLPFNDSQFNPDGYFWAIIHLLCVGAYKILQKSQKPSALSDIDQQYLNYIFSGFLGFFLMFSTVKLKNLLAPGQCAAWIFFAKIITAGLSILLFDAILTSATTGCLLLGALGEALLVFSELEELLNKTVKRKTHRLLRENSLYTCVRAPGLIAPCWMCQKEECKDSEARWAVHHLTQVNVVVADEAEAWCFKEHLSGGLQVTAGGAVCYIFFHLENLSQRAVAGSAETRKYQDFMGWSGRSMSFNFWMANALSQKLVSVKGMGKGWGVIPRKT

SEQ ID NO: 757244 - protein, 133 aa, Homo sapiens
MCVRRSLVGLTFCTCYLASYLTNKYVLSVLKFTYPTLFQGSHVLVWLPASVLFVGIIYAGSRALSRLAIPVFLTLHNVAEVIICGYQKCFQKEKTSPAKICSALFLLAAAGCLPFNDSQGLIKFYRSPRNPVH

SEQ ID NO: 757245 - protein, 169 aa, Homo sapiens
MPPARCAWRGLAGFLRAEELLNKTVKRKTHRLLRENSLYTCVRAPGLIAPCWMCQKEECKDSEARWAVHHLTQVNVVVADEAEAWCFKEHLSGGLQVTAEEAVCYIFFHLENLSQRAVAGSAETRKYQDFMGWSGRSMSFNFWMANALSQKLVSVKGMGKGWGVIPRKT

SEQ ID NO: 757246 - protein, 156 aa, Homo sapiens
ADETLQDTTLRYWERRRSVQQSVIVNQKAALPVASERVFGSVGKRLESLPKALYPGAKEETLASSSCWDCAGLSTQKTQGYLSEDTSMNSSLPFCSWKKAAAQRPRSSLRAFLDPHRNLEQESLLPNRVLQSVLKQGCPKGYHLLLASATLQPDKR

SEQ ID NO: 757247 - protein, 212 aa, Homo sapiens
SSSQLQPQESGRAEQGSQRGEKMKGKMVSQVPSQGPCVHMEAGVDYLSPGPGEPSNSKVLVSGKRKDKASASSSAKKREHPRKPKAGDHRRGTARLGLSTVTGKNHPAQARSLVEAPVSTFPQRSQHRGQSSQHTALPQLLLPKASGPQDQPEAGRRASDILTPRHCKHCPWAHMEKYLSFPTLKASLTRGLQKVLAKCLDNHRPLPTKSSQ

SEQ ID NO: 757248 - protein, 340 aa, Homo sapiens
MKEDQVVAEEPGFQDEEESLFQDIDLLQKHGINVADIKKLKSVGICTIKGIQMTTRRALCNVKGLSEAKVDKIKEAANKLIEPGFLTAFEYSEKRKMVFHITTGSQEFDKLLGGGIESMAITEAFGEFRTGKTQLSHTLCVTAQLPGAGGYPGGKIIFIDTENTFRPDRLRDIADRFNVDHDAVLDNVLYARAYTSEHQMELLDYVAAKFHEEAGIFKLLIIDSIMALFRVDFSGRGELAERQQKLAQMLSRLQKISEEYNVAVFVTNQMTADPGATMTFQADPKKPIGGHILAHASTTRISLRKGRGELRIAKIYDSPEMPENEATFAITAGGIGDAKE

SEQ ID NO: 757249 - protein, 96 aa, Homo sapiens
STEEFYALCDQLELCLRLAHECLSQSCDSAKHSPTLVPTATKPDAVQPDSLPYPQYLAVIKAQISCAKDIHTALLDCANKVTGKTPAPPAGPGGTL

SEQ ID NO: 757250 - protein, 96 aa, Homo sapiens; identical to SEQ ID NO: 757249

SEQ ID NO: 757251 - protein, 96 aa, Homo sapiens; identical to SEQ ID NO: 757249

SEQ ID NO: 757252 - protein, 96 aa, Homo sapiens; identical to SEQ ID NO: 757249

SEQ ID NO: 757253 - protein, 144 aa, Homo sapiens
QAGRKLPTSVDLPASASQSAGITGVSHCAPSSLVLLMKDGIWRARRAVERVRTLCVDGESWEDSEQGNGRGRPGFAWGHDGVQGHLVAAVQVFTTTEGRTRIEKRVDCSSFVIESAQREDEGRYTIKVTNPVGEDVASIFLQVV

SEQ ID NO: 757254 - protein, 1141 aa, Homo sapiens
MPEAKPAAKKAPKGKDAPKGAPKEAPPKEAPAEAPKEAPPEDQSPTAEEPTGVFLKKPDSVSVETGKDAVVVAKVNGKELPDKPTIKWFKGKWLELGSKSGARFSFKESHNSASNVYTVELHIGKVVLGDRGYYRLEVKAKDTCDSCGFNIDVEAPRQDASGQSLESFKRTSEKKSDTAGELDFSGLLKKREVVEEEKKKKKKDDDDLGIPPEIWELLKGAKKSEYEKIAFQYGITDLRGMLKRLKKAKVEVKKSAAFTKKLDPAYQVDRGNKIKLMVEISDPDLTLKWFKNGQEIKPSSKYVFENVGKKRILTINKCTLADDAAYEVAVKDEKCFTELFVKEPPVLIVTPLEDQQVFVGDRVEMAVEVSEEGAQVMWMKDGVELTREDSFKARYRFKKDGKRHILIFSDVVQEDRGRYQVITNGGQCEAELIVEEKQLEVLQDIADLTVKASEQAVFKCEVSDEKVTGKWYKNGVEVRPSKRITISHVGRFHKLVIDDVRPEDEGDYTFVPDGYALSLSAKLNFLEIKVEYVPKQEPPKIHLDCSGKTSENAIVVVAGNKLRLDVSITGEPPPVATWLKGDEVFTTTEGRTRIEKRVDCSSFVIESAQREDEGRYTIKVTNPVGEDVASIFLQVVDVPDPPEAVRITSVGEDWAILVWEPPMYDGGKPVTGYLVERKKKGSQRWMKLNFEVFTETTYESTKMIEGILYEMRVFAVNAIGVSQPSMNTKPFMPIAPTSEPLHLIVEDVTDTTTTLKWRPPNRIGAGGIDGYLVEYCLEGSEEWVPANTEPVERCGFTVKNLPTGARILFRVVGVNIAGRTEPATLAQPVTIREIAEPPKIRLPRHLRQTYIRKVGEQLNLVVPFQGKPRPQVVWTKGGAPLDTSRVHVRTSDFDTVFFVRQAARSDSGEYELSVQIENMKDTATIRIRVVEKAGPPINVMVKEVWGTNALVEWQAPKDDGNSEIMGYFVQKADKKTMEWFNVYERNRHTSCTVSDLIVGNEYYFRVYTENICGLSDSPGVSKNTARILKTGITFKPFEYKEHDFRMAPKFLTPLIDRVVVAGYSAALNCAVRGHPKPKVVWMKNKMEIREDPKFLITNYQGVLTLNIRRPSPFDAGTYTCRAVNELGEALAECKLEVRVPQ

SEQ ID NO: 757255 - protein, 515 aa, Homo sapiens
SLSWASGRLKGKTRPFEACEAKGSRSSGLAGLAGLGRWTPGLAAGAEHRAAFSWGSGGGPGTTAGLAPPRTGRDGEVPPTRPRPRAAPRAAPTSFLPRQPRALRAGPNRGGAGEGGGRRAMPWSSRGALLRDLVLGVLGTAAFLLDLGTDLWAAVQYALGGRYLWAALVLALLGLASVALQLFSWLWLRADPAGLHGSQPPRRCLALLHLLQLGYLYRCVQELRQGLLVWQQEEPSEFDLAYADFLALDISMLRLFETFLETAPQLTLVLAIMLQSGRAEYYQWVGICTSFLGISWALLDYHRALRTCLPSKPLLGLGSSVIYFLWNLLLLWPRVLAVALFSALFPSYVALHFLGLWLVLLLWVWLQGTDFMPDPSSEWLYRVTVATILYFSWFNVAEGRTRGRAIIHFAFLLSDSILLVATWVTHSSWLPSGIPLQLWLPVGCGCFFLGLALRLVYYHWLHPSCCWKPDPDQVDGARSLLSPEGYQLPQNRRMTHLAQKFFPKAKDEAASPVKG

SEQ ID NO: 757256 - protein, 532 aa, Homo sapiens
SLSWASGRLKGKTRPFEACEAKGSRSSGLAGLAGLGRWTPGLAAGAEHRAAFSWGSGGGPGTTAGLAPPRTGRDGEVPPTRPRPRAAPRAAPTSFLPRQPRALRAGPNRGGAGEGGGRRAMPWSSRGALLRDLVLGVLGTAAFLLDLGTDLWAAVQYALGGRYLWAALVLALLGLASVALQLFSWLWLRADPAGLHGSQPPRRCLALLHLLQLGYLYRCVQELRQGLLVWQQEEPSEFDLAYADFLALDISMLRLFETFLETAPQLTLVLAIMLQSGRAEYYQYTRSHFVTQAGLELLSSRVGICTSFLGISWALLDYHRALRTCLPSKPLLGLGSSVIYFLWNLLLLWPRVLAVALFSALFPSYVALHFLGLWLVLLLWVWLQGTDFMPDPSSEWLYRVTVATILYFSWFNVAEGRTRGRAIIHFAFLLSDSILLVATWVTHSSWLPSGIPLQLWLPVGCGCFFLGLALRLVYYHWLHPSCCWKPDPDQVDGARSLLSPEGYQLPQNRRMTHLAQKFFPKAKDEAASPVKG

SEQ ID NO: 757257 - protein, 515 aa, Homo sapiens; identical to SEQ ID NO: 757255

SEQ ID NO: 757258 - protein, 127 aa, Homo sapiens
PSSACLLWRICAPGKGKRSDCQTLHRTQCFPVIAESKTGLNSTDAYPGSKHSDQPSQRGIAHPNGQDLRSGKPCHCGLEGSEVLNKLERRSRPQGLQPLGMSCAELGSEPGDLVGLGEHNLLRHQLR

SEQ ID NO: 757259 - protein, 439 aa, Homo sapiens [sequence omitted]

SEQ ID NO: 757260 - protein, 439 aa, Homo sapiens [sequence omitted]

SEQ ID NO: 757261 - protein, 188 aa, Homo sapiens
ARADFCFRVGAMAVANSSPVNPVVFFDVSIGGQEVGRMKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 757262 - protein, 73 aa, Homo sapiens
GQYEPLKDFQQNTVDEFSCSEDDSSSIVEDGLEASEESTAVVVQAREKRFYMKIWVWGTLEIWQQIFMCLLGM

SEQ ID NO: 757263 - protein, 188 aa, Homo sapiens; identical to SEQ ID NO: 757261

SEQ ID NO: 757264 - protein, 177 aa, Homo sapiens
MAVANSSPVNPVVFFDVSIGGQEVGRMKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 757265 - protein, 151 aa, Homo sapiens
MKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 757266 - protein, 151 aa, Homo sapiens; identical to SEQ ID NO: 757265

SEQ ID NO: 757267 - protein, 228 aa, Homo sapiens
DAWVLDRDLEPMAVANSSPVNPVVFFDVSIGGQEVGRMKIELFADVVPKTAENFRQFCTGEFRSVSDVFDFFACSRGVFWGCSEGIGEPPAGLEMIAGDSDRRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 757268 - protein, 188 aa, Homo sapiens; identical to SEQ ID NO: 757261

SEQ ID NO: 757269 - protein, 188 aa, Homo sapiens; identical to SEQ ID NO: 757261

SEQ ID NO: 757270 - protein, 188 aa, Homo sapiens; identical to SEQ ID NO: 757261

SEQ ID NO: 757271 - protein, 188 aa, Homo sapiens; identical to SEQ ID NO: 757261

SEQ ID NO: 757272 - protein, 188 aa, Homo sapiens
DAWVLDRDLEPMAVANSSPVNPVVFFDVSIGGQEVGRMKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 757273 - protein, 144 aa, Homo sapiens
DAWVLDRDLEPMAVANSSPVNPVVFFDVSIGGQEVGRMKIELFADVVPKTAENFRQFCTGEFRKDGVPIGYKGSTFHRVIKDFMIQGGDFVNGDGTGVASIYRGPFAERTVVQVQMAVSSLSPALSAIGWMGSMWCLEKSSMDF

SEQ ID NO: 757274 - protein, 188 aa, Homo sapiens; identical to SEQ ID NO: 757261

SEQ ID NO: 757275 - protein, 188 aa, Homo sapiens; identical to SEQ ID NO: 757261

SEQ ID NO: 757276 - protein, 188 aa, Homo sapiens; identical to SEQ ID NO: 757261

SEQ ID NO: 757277 - protein, 149 aa, Homo sapiens
MAVANSSPVNPVVFFDVSIGGQEVGRMKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFECSHRPQQ

SEQ ID NO: 757278 - protein, 188 aa, Homo sapiens; identical to SEQ ID NO: 757261

SEQ ID NO: 757279 - protein, 173 aa, Homo sapiens
ARADFCFRVGAMAVANSSPVNPVVFFDVSIGGQEVGRMKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFEKSFMDFYEEKDENGPNRPNH

SEQ ID NO: 757280 - protein, 99 aa, Homo sapiens
DAWVLDRDLEPMAVANSSPVNPVVFFDVSIGGQEVGRMKIELFADVVPKTAENFRQFCTGEFRKDGVPIGYKGSTFHRVIKDFMIQGGDFVNEKSSMDF

SEQ ID NO: 757281 - protein, 73 aa, Homo sapiens; identical to SEQ ID NO: 757262

SEQ ID NO: 757282 - protein, 228 aa, Homo sapiens; identical to SEQ ID NO: 757267

SEQ ID NO: 757283 - protein, 71 aa, Homo sapiens
VNALHLPAYMDSFLTRNYHCLLCAGQHASCREGDKELKDVSFQELMESKTFPEVITSNMSDIAFPSSWWCS

SEQ ID NO: 757284 - protein, 68 aa, Homo sapiens
DAWVLDRDLEPMAVANSSPVNPVVFFDVSIGGQVRSRRLPTPAPKGNCSGLGRQNSPRESGLGKPARK

SEQ ID NO: 757285 - protein, 148 aa, Homo sapiens [sequence omitted]

SEQ ID NO: 757286 - protein, 148 aa, Homo sapiens [sequence omitted]

SEQ ID NO: 757287 - protein, 148 aa, Homo sapiens [sequence omitted]

SEQ ID NO: 757288 - protein, 148 aa, Homo sapiens [sequence omitted]

SEQ ID NO: 757289 - protein, 148 aa, Homo sapiens [sequence omitted]

SEQ ID NO: 757290 - protein, 105 aa, Homo sapiens
RIPHHAPSWGASNQRILAYPGTQPQAVGSQWPGGKQLHSPALPGCPFGFQPGSRPASTGKPVTEAWTQRWTRHLLATCDLGRSESVARSTCSAAAINSLPVSKRR

SEQ ID NO: 757291 - protein, 148 aa, Homo sapiens [sequence omitted]

SEQ ID NO: 757292 - protein, 204 aa, Homo sapiens
MFHGIPATPGIGAPGNKPELYEEVKLYKNAREREKYDNMAELFAVVKTMQALEKAYIKDCVSPSEQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 757293 - protein, 221 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 757294 - protein, 221 aa, Homo sapiens; identical to SEQ ID NO: 757293

SEQ ID NO: 757295 - protein, 115 aa, Homo sapiens
MERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 757296 - protein, 115 aa, Homo sapiens; identical to SEQ ID NO: 757295

SEQ ID NO: 757297 - protein, 183 aa, Homo sapiens
MAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 757298 - protein, 115 aa, Homo sapiens; identical to SEQ ID NO: 757295

SEQ ID NO: 757299 - protein, 115 aa, Homo sapiens; identical to SEQ ID NO: 757295

SEQ ID NO: 757300 - protein, 221 aa, Homo sapiens; identical to SEQ ID NO: 757293

SEQ ID NO: 757301 - protein, 107 aa, Homo sapiens
MPWGLPHPWTREPHVHTCPQLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 757302 - protein, 164 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSVRPSPQGTWLGEPRLPAAAGHERRVLGLQS

SEQ ID NO: 757303 - protein, 221 aa, Homo sapiens; identical to SEQ ID NO: 757293

SEQ ID NO: 757304 - protein, 221 aa, Homo sapiens; identical to SEQ ID NO: 757293

SEQ ID NO: 757305 - protein, 126 aa, Homo sapiens
MAELFAVVKTMQALEKAYIKDCVSPSEYTAACSRLLVQYKAAFRQVQGSEISSIDEFCRKFRLDCPLAMERIKEDRPITIKDDKGNLNRCIADVVSVRPSPQGTWLGEPRLPAAAGHERRVLGLQS

SEQ ID NO: 757306 - protein, 221 aa, Homo sapiens; identical to SEQ ID NO: 757293

SEQ ID NO: 757307 - protein, 145 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSAADPERHVGVR

SEQ ID NO: 757308 - protein, 233 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWGCPEGMSAQIAGDSQGVDACRLDEATKLKPFLMPSPGTSPAQGSGLLWPR

SEQ ID NO: 757309 - protein, 213 aa, Homo sapiens
YKNAREREKYDNMADCCRYVIPLRSTKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 757310 - protein, 221 aa, Homo sapiens; identical to SEQ ID NO: 757293

SEQ ID NO: 757311 - protein, 183 aa, Homo sapiens; identical to SEQ ID NO: 757297

SEQ ID NO: 757312 - protein, 183 aa, Homo sapiens; identical to SEQ ID NO: 757297

SEQ ID NO: 757313 - protein, 115 aa, Homo sapiens; identical to SEQ ID NO: 757295

SEQ ID NO: 757314 - protein, 115 aa, Homo sapiens; identical to SEQ ID NO: 757295

SEQ ID NO: 757315 - protein, 221 aa, Homo sapiens; identical to SEQ ID NO: 757293

SEQ ID NO: 757316 - protein, 131 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRVSAWSFHPHGARLSGMGMGCQRALATWGLLS

SEQ ID NO: 757317 - protein, 221 aa, Homo sapiens; identical to SEQ ID NO: 757293

SEQ ID NO: 757318 - protein, 261 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWVGVPPSQAEPRSARDPPSQAEPRSAPEALSPHMPCAALPGLQTLSGMSASDELDDSQVRQMLFDLESAYNAFNRFLHA

SEQ ID NO: 757319 - protein, 163 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEAADPERHVGVR

SEQ ID NO: 757320 - protein, 117 aa, Homo sapiens
CRVADRAHPAPGAIFPTASRPGSCSVSQAGVQWLSLGSLKPSPPGFKRFSCLSLLSSWDYNRMPQRPANFVILVETGFHHVGQAGLKLLTSGDPLTSASQSAGITGVSHRTWLRGHL

SEQ ID NO: 757321 - protein, 104 aa, Homo sapiens
MSHEQGVATVVQVTPPGSHGGAGELGLSCGPPGSRSGAGELGLSCGPPGSRSGAGELGLSCGPRLLRGVIIRSPHTLIGVRLEPLCSSSLWALWDPAWEASGRN

SEQ ID NO: 757322 - protein, 113 aa, Homo sapiens
MKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 757323 - protein, 74 aa, Homo sapiens
AADYYYYTIKFAAASTPKEQGLLTKALPGRVRTLTILEMGFEWHNTFYFTKDQKPEAPGSVLMNSLAEPWPWQV

SEQ ID NO: 757324 - protein, 226 aa, Homo sapiens
PTSSFPSSGAFPSPRAFSVQGLSWVSRVSGAGQAGQAGLLLPGEPRWGGQWAGSRRAWCQGRAFRTGTGWGLCAEPRGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 757325 - protein, 207 aa, Homo sapiens
HKDGSALRSESRLLLRAEGERHTLLLREARAADAGSYMATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 757326 - protein, 226 aa, Homo sapiens; identical to SEQ ID NO: 757324

SEQ ID NO: 757327 - protein, 226 aa, Homo sapiens; identical to SEQ ID NO: 757324

SEQ ID NO: 757328 - protein, 140 aa, Homo sapiens
MPCLAEYDDGLWYRAKIVAIKEFNPLSILVQFVDYGSTAKLTLNRLCQIPSHLMRYPARAIKVLLAGFKPPLRDLGETRIPYCPKWSMEALWAMIDCLQGKQLYAVSMAPAPEQIVTLYDDEQHPVHMPLVEMGLADKDE

SEQ ID NO: 757329 - protein, 414 aa, Homo sapiens
YNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMVI

SEQ ID NO: 757330 - protein, 668 aa, Homo sapiens
YNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMKPRSDHDKKYEEEQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLCQIPSHLMRYPARAIKVLLAGFKPPLRDLGETRIPYCPKWSMEALWAMIDCLQGKQLYAVSMAPAPEQIVTLYDDEQHPVHMPLVEMGLADKDE

SEQ ID NO: 757331 - protein, 485 aa, Homo sapiens
YNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMKPRSDHDKKYEEEQWEIRFEELLSAETDTPLLPPYLSSSLPSPGTVGYDRLSSRKTTLCCVHGSSTRTDSDII

SEQ ID NO: 757332 - protein, 327 aa, Homo sapiens
ELVRIQPRLQLSAVPPPVAARVITETQMDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQNFEAVCQTEEFFELTHADLDEIVSNDCLNVATEETVFYALESWIKYDVQERQKYLAQLLNSVRLPLLSVKFLTRLYEANHLIRDDRTCKHLLNEALKYHFMPEHRLSHQTVLMTRPRCAPKVLCAVGGKSGLFACLDR

SEQ ID NO: 757333 - protein, 345 aa, Homo sapiens
ELVRIQPRLQLSAVPPPVAARVITETQMDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQNFEAVCQTEEFFELTHADLDEIVSNDCLNVATEETVFYALESWIKYDVQERQKYLAQLLNSVRLPLLSVKFLTRLYEANHLIRDDRTCKHLLNEALKYHFMPEHRLSHQTVLMTRPRCAPKVLCAVGGKSGLFACLDRLASYPCDVFYHEMTLPRC

SEQ ID NO: 757334 - protein, 314 aa, Homo sapiens
MHFKCKYSYPALYQMDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQNFEAVCQTEEFFELTHADLDEIVSNDCLNVATEETVFYALESWIKYDVQERQKYLAQLLNSVRLPLLSVKFLTRLYEANHLIRDDRTCKHLLNEALKYHFMPEHRLSHQTVLMTRPRCAPKVLCAVGGKSGLFACLDR

SEQ ID NO: 757335 - protein, 325 aa, Homo sapiens
MHFKCKYSYPALYQMDHTSPTYMLANLTHLHSEQLLQGLNLLRQHHELCDIILRVGDVKIHAHKVVLASVSPYFKAMFTGNLSEKENSEVEFQCIDETALQAIVEYAYTGTVFISQDTVESLLPAANLLQIKLVLKECCAFLESQLDPGNCIGISRFAETYGCRDLYLAATKYICQNFEAVCQTEEFFELTHADLDEIVSNDCLNVATEETVFYALESWIKYDVQERQKYLAQLLNSVRLPLLSVKFLTRLYEANHLIRDDRTCKHLLNEALKYHFMPEHRLSHQTVLMTRPRCVLGLQAKATAPSLIIHFNCNLKLVLLRLGYT

SEQ ID NO: 757336 - protein, 83 aa, Homo sapiens
MSFFQLLMKRKELIPLVVFMTVAAGGASSFAVYSLWKTDVILDRKKNPEPWETVDPTVPQKLITINQQWKPIEELQNVQRVTK

SEQ ID NO: 757337 - protein, 83 aa, Homo sapiens; identical to SEQ ID NO: 757336

SEQ ID NO: 757338 - protein, 109 aa, Homo sapiens
TTQNTQPPNPPHTKPHFIWQFFAEVIMSFFQLLMKRKELIPLVVFMTVAAGGASSFAVYSLWKTDVILDRKKNPEPWETVDPTVPQKLITINQQWKPIEELQNVQRVTK

SEQ ID NO: 757339 - protein, 114 aa, Homo sapiens
KYKQRPTQSTNCHDNTPNRLSTIWQFFAEVIMSFFQLLMKRKELIPLVVFMTVAAGGASSFAVYSLWKTDVILDRKKNPEPWETVDPTVPQKLITINQQWKPIEELQNVQRVTK

SEQ ID NO: 757340 - protein, 83 aa, Homo sapiens; identical to SEQ ID NO: 757336

SEQ ID NO: 757341 - protein, 767 aa, Homo sapiens
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 757342 - protein, 667 aa, Homo sapiens
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQRD

SEQ ID NO: 757343 - protein, 410 aa, Homo sapiens
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVREGHA

SEQ ID NO: 757344 - protein, 100 aa, Homo sapiens
KDIQAHKFIEAGQYNSHLYGTSVQSVREVAEQVGPGGHPVLFLLPSPHPTASLQLSLTLSLSVSFPAGSPLRSSTSFSSWATLSDCLLSAPALSPTSLTS

SEQ ID NO: 757345 - protein, 145 aa, Homo sapiens
AGRIPRALKSPKHPAGLAVLSAGKAKWVRGDPRQAGDSLTRSPSLTLDGPSTCHVLRTQQSERRRCPPGICSRLQRRPLSSCASGWIAALLPAQCLPASPREKQPLVFSLQFPFSTLSLLLSPGAADPSSWFPEILASPVSGKAM

SEQ ID NO: 757346 - protein, 191 aa, Homo sapiens
AGRIPRALKSPKHPAGLAVLSAGKAKWVRGDPRQAGDSLTRSPSLTLDGPSTCHVLRTQQSERRRCPPGICSRLQRRPLSSCASGWIAALLPAQCLPASPREKQPLVFSLQFPGSQRSWPARSQARPCRMPGVIIAYCFMTASLCPGGSFSWNALPTTPAAALLRALLSLTSFEATLSLSPDHLALSLLSA

SEQ ID NO: 757347 - protein, 186 aa, Homo sapiens
AGRIPRALKSPKHPAGLAVLSAGKAKWVRGDPRQAGDSLTRSPSLTLDGPSTCHVLRTQQSERRRCPPGICSRLQRRPLSSCASGWIAALLPAQCLPASPREKQPLVFSLQFPFSTLSLLLSPGAADPSYASIAPKNSGPVPRARRPSGEVDGPRRSPCGENRVLEPLEPPEPPELQPGQPPFRRE

SEQ ID NO: 757348 - protein, 486 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGARGPSGDEGPAGEPGPPGEKGEAGDEGNPGPDGAPGERGGPGERGPRGTPGPRGPRGDPGEAGTSVLHPTSLSKTPSRGLCRTSLPLLCPHSWFFPPILT

SEQ ID NO: 757349 - protein, 1027 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGARGPSGDEGPAGEPGPPGEKGEAGDEGNPGPDGAPGERGGPGERGPRGTPGPRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQAKSAVDKLGSMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 757350 - protein, 70 aa, Homo sapiens
VQEAQRAGIEIFVVVVGRQVNEPHIRVLVTGKTAEYDVAYGESHLFRVPSYQALLRGVFHQTVSRKVALG

SEQ ID NO: 757351 - protein, 486 aa, Homo sapiens
MIRRVLPHGMGRGLLTRRPGTRRGGFSLDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 757352 - protein, 572 aa, Homo sapiens
MIRRVLPHGMGRGLLTRRPGTRRGGFSLDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVTGKGWFPFYFWTLDGTDDSGAHWSPRTRDCRSPSMSQLLRNFLDTSHPIDPSAAGRGYSVLSPEGSEDGVWLQPSREPQCFVHPQVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 757353 - protein, 316 aa, Homo sapiens
MESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 757354 - protein, 316 aa, Homo sapiens; identical to SEQ ID NO: 757353

SEQ ID NO: 757355 - protein, 486 aa, Homo sapiens; identical to SEQ ID NO: 757351

SEQ ID NO: 757356 - protein, 443 aa, Homo sapiens
MIRRVLPHGMGRGLLTRRPGTRRGGFSLDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVKNPPIWGFKPPSFF

SEQ ID NO: 757357 - protein, 135 aa, Homo sapiens [sequence omitted]

SEQ ID NO: 757358 - protein, 174 aa, Homo sapiens
MWEGNVWPSDPNYITTDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRWVPGTAS

SEQ ID NO: 757359 - protein, 486 aa, Homo sapiens; identical to SEQ ID NO: 757351

SEQ ID NO: 757360 - protein, 484 aa, Homo sapiens
AEEAFLCACLASGSRGPGPCRGGFSLDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 757361 - protein, 454 aa, Homo sapiens
MTAAGTGWGLLLKHWWLQALMISDAWGLSIFLGSLFLFILLFFFLLGRPPARAGLRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 757362 - protein, 275 aa, Homo sapiens
MEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 757363 - protein, 312 aa, Homo sapiens
EGKIRLGQAGVTLRAAGQLARSSEWRLARSSDGCDNSEAAVQLSEDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGSEDEGRQTPGGNGTKETTGEEARPREYQRAQGEGDTVSNPTCYKRKENHEKHHSRETETGNQKRHGEKRNGTGSTRRGKAQMAT

SEQ ID NO: 757364 - protein, 194 aa, Homo sapiens
MKLASGFLVLWLSLGGGLAQSDTSPDTEESYSDWGLRHLRGSFESVNSYFDSFLELLGGKNGVCQYRCRYGKAPMPRPGYKPQEPNGCGSYFLGLKVPESMDLGIPAMTKCCNQLDVCYDTCGANKYRCDAKFRWCLHSICSDLKRSLGFVSKVEACDSLVDTVFNTVWTLGCRPFMNSQRAACICAEEEKEEL

SEQ ID NO: 757365 - protein, 117 aa, Homo sapiens
MESPGLSALAEGLQDEDTLCKASHFCCCWAHCVKFPPPSFHLPYAELPLLHPPWPAKPTPPHFLLTTQAQPLTCPMAVTALSWALNGIIVTCVLMSLCHSTPSTSNKELKTYRILNK

SEQ ID NO: 757366 - protein, 131 aa, Homo sapiens
MLWRFTPVVTCDSVSSAWWGVPWCFPVFCDCPVKAIGMGSGGGSLKPVDTARVHCPGKRQTLGPSGRREVAAGAAAGGGADDVPCQEPQEEGAWDLWPVVAVYSFSLYCGFLLFNSFSICFSSINFIPCSS

SEQ ID NO: 757367 - protein, 122 aa, Homo sapiens
MDEAASVPPFCPALRCHSTRPTRPPRKAMFMAETKGVALNQLSLRELQTIRCGPPPSPRCLQVAWHPGPPLPLFSPLFSGDMSRMWEYGHSVEQYSALDGTEHSSVDWQICQVRALLQAQQA

SEQ ID NO: 757368 - protein, 76 aa, Homo sapiens
KLGTELGSTSKKPPLVLEFGLPSGLTKTTFVLAQQDSQTLFWVAPGVIQKDKKLLMPLHSPQLLRSKLFIEPVSIN

SEQ ID NO: 757369 - protein, 69 aa, Homo sapiens
PPQEQERKAGGALTKHPLCAGPFAHNIPLNPCKHHARLLCEAHFIDEEAKAQGDDVTCHKLAGGDRERS

SEQ ID NO: 757370 - protein, 399 aa, Homo sapiens
MAQRQPHSPNQTLISITNDTESSSSVVSNDNTNKGWSGDNSPGIEALCAIYITYAVIISVGILGNAILIKVFFKTKSMQTVPNIFITSLAFGDLLLLLTCVPVDATHYLAEGWLFGRIGCKVLSFIRLTSVGVSVFTLTILSADRYKAVVKPLERQPSNAILKTCVKAGCVWIVSMIFALPEAIFSNVYTFRDPNKNMTFESCTSYPVSKKLLQEIHSLLCFLVFYIIPLSIISVYYSLIARTLYKSTLNIPTEEQSHARKQIESRKRIARTVLVLVALFALCWLPNHLLYLYHSFTSQTYVDPSAMHFIFTIFSRVLAFSNSCVNPFALYWLSKSFQKHFKAQLFCCKAERPEPPVADTSLTTLAVMGTVPGTGSIQMSEISVTSFTGCSVKQAEDRF

SEQ ID NO: 757371 - protein, 238 aa, Homo sapiens
RICPGAAPRAGEAGGLRRPALLLCPGPARPRVAAREMMQDVSSSPVSPADDSLSNSEEEPDRQQPPSGKRGGRKRRSSRRSAGGGAGPGGAAGGGVGGGDEPGSPAQGKRGKKSAGCGGGGGAGGGGGSSSGGGSPQSYEELQTQRVMANVRERQRTQSLNEAFAALRKIIPTLPSDKLSKIQTLKLAARYIDFLYQVLQSDELDSKMASCSYVAHERLSYAFSVWRMEGAWSMSASH

SEQ ID NO: 757372 - protein, 91 aa, Homo sapiens
SVTGAARAREVGSHSPDFLREDPCPPLPSDKLSKIQTLKLAARYIDFLYQVLQSDELDSKMASCSYVAHERLSYAFSVWRMEGAWSMSASH

SEQ ID NO: 757373 - protein, 238 aa, Homo sapiens; identical to SEQ ID NO: 757371

SEQ ID NO: 757374 - protein, 238 aa, Homo sapiens; identical to SEQ ID NO: 757371

SEQ ID NO: 757375 - protein, 212 aa, Homo sapiens
MDYLLMIFSLLFVACQGAPETAVLGAELSAVGENGGEKPTPSPPWRLRRSKRCSCSSLMDKECVYFCHLDIIWVNTPEHVVPYGLGSPRSKRALENLLPTKATDRENRCQCASQKDKKCWNFCQAGKELRAEDIMEKDWNNHKKGKDCSKLGKKCIYQQLVRGRKIRRSSEEHLRQTRSETMRNSVKSSFHDPKLKGKPSRERYVTHNRAHW

SEQ ID NO: 757376 - protein, 212 aa, Homo sapiens; identical to SEQ ID NO: 757375

SEQ ID NO: 757377 - protein, 66 aa, Homo sapiens
ELFTPTLIGVQYKKPAESCPSQTRLCICARRTGPAPPAVPALHRRVRLQTLRSLPSLLAGAAFSPR

SEQ ID NO: 757378 - protein, 154 aa, Homo sapiens
MDKECVYFCHLDIIWVNTPEHVVPYGLGSPRSKRALENLLPTKATDRENRCQCASQKDKKCWNFCQAGKELRAEDIMEKDWNNHKKGKDCSKLGKKCIYQQLVRGRKIRRSSEEHLRQTRSETMRNSVKSSFHDPKLKGKPSRERYVTHNRAHW

SEQ ID NO: 757379 - protein, 212 aa, Homo sapiens; identical to SEQ ID NO: 757375

SEQ ID NO: 757380 - protein, 95 aa, Homo sapiens
PPVSLFPPCRCSPRVAVPPVSLFPPCPYSSRVRIPYLHLFLQVGLRVLVQHMCFPLRLLGGSGWVWAPCSQAHVVFMAVAAWVMSVSLHLGFPGP

SEQ ID NO: 757381 - protein, 90 aa, Homo sapiens
GSRGDDEVRRRWQLTFADGASLKGKFKVQLGAAALGVRTCGCGYEGASSAMPLAPGEAVPVTLCQSNGEAAVVRPDQIKPNQANHGEWRT

SEQ ID NO: 757382 - protein, 87 aa, Homo sapiens
RKKNPAESRSSCCPFCPHMKRLCGSDSMSYGPVDPGGSHTVSRIIACSSKPFTVEWKPVIFLASCMTEKVSVANSELQHQETRSSSH

SEQ ID NO: 757383 - protein, 104 aa, Homo sapiens
LGAVRLNPQTHKKIPEASLTFADGASLKGKFKVQLGAAALGVRTCGCGYEGASSAMPLAPGEAVPVTLCQSNGEAAVVRPDQIKPNQANHGEWRLLPAPPSPSL

SEQ ID NO: 757384 - protein, 90 aa, Homo sapiens; identical to SEQ ID NO: 757381

SEQ ID NO: 757385 - protein, 185 aa, Homo sapiens
GSRGDDEVRRRWQLTFADGASLKGKFKVQLGAAALGVRTCGCGYEGASSAMPLAPGEAVPVTLCQSNGEAAVVRPDQIKPNQANHGEWRIYLALNSGQKKTQTLSCGLGPPILIKVWFHLLPHKGAIAVCTSESVYNLRIEIIACSSKPFTVEWKPVIFLASCMTEKVSVANSELQHQETRSSSH

SEQ ID NO: 757386 - protein, 99 aa, Homo sapiens
EVRRVWQLTFADGASLKGKFKVQLGAAALGVRTCGCGYEGASSAMPLAPGEAVPVTLCQSNGEAAVVRPDQIKPNQANHGEWRHRVSFCHPGWSADAVA

SEQ ID NO: 757387 - protein, 99 aa, Homo sapiens; identical to SEQ ID NO: 757386

SEQ ID NO: 757388 - protein, 151 aa, Homo sapiens
LLCLECDSRGSPLRSLGVRTCGCGYEGASSAMPLAPGEAVPVTLCQSNGEAAVVRPDQIKPNQANHGEWRGHVSTQHKGSCPQARKRSIIRNRPYWLPDLRLSASRMIIACSSKPFTVEWKPVIFLASCMTEKVSVANSELQHQETRSSSH

SEQ ID NO: 757389 - protein, 99 aa, Homo sapiens; identical to SEQ ID NO: 757386

SEQ ID NO: 757390 - protein, 99 aa, Homo sapiens; identical to SEQ ID NO: 757386

SEQ ID NO: 757391 - protein, 203 aa, Homo sapiens
EVRRVWQLTFADGASLKGKFKVQLGAAALGVRTCGCGYEGASSAMPLAPGEAVPVTLCQSNGEAAVVRPDQIKPNQANHGEWRIYLALNSGQKKTQTLSCGLGPPILIKVWFHLLPHKGAIAVCTSESVYNLRIEDLMIDLASLASGHCSAWPYCCLHPQLLQLFWPLCVTALPSPASWLSKERSVSYRRSQQKDEIWGAGEG

SEQ ID NO: 757392 - protein, 110 aa, Homo sapiens
MDLWTLVAVTQCQGIYLALNSGQKKTQTLSCGLGPPILIKVWFHLLPHKGAIAVCTSESVYNLRIEIIACSSKPFTVEWKPVIFLASCMTEKVSVANSELQHQETRSSSH

SEQ ID NO: 757393 - protein, 104 aa, Homo sapiens; identical to SEQ ID NO: 757383

SEQ ID NO: 757394 - protein, 102 aa, Homo sapiens
MGSKDHAVFFREMTQLILNEMPKAGYSSILNDFVESNFFVIDGDSLLVTCLGVKSFKWGQNLHFFYLVECYLVDLLSNGGQFTIVFFKDAEYAYFDFPELLS

SEQ ID NO: 757395 - protein, 512 aa, Homo sapiens
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGDPKAPDVYDFFLQWIGRGLLVLEGPKWLQHRKLLTPGFHYDVLKPYVAVFTESTRIMLDKWEEKAREGKSFDIFCDVGHMALNTLMKCTFGRGDTGLGHSRDSSYYLAVSDLTLLMQQRLVSFQYHNDFIYWLTPHGRRFLRACQVAHDHTDQVIRERKAALQDEKVRKKIQNRRHLDFLDILLGARDEDDIKLSDADLRAEVDTFMFEGHDTTTSGISWFLYCMALYPEHQHRCREEVREILGDQDFFQWDDLGKMTYLTMCIKESFRLYPPVPQVYRQLSKPVTFVDGRSLPAGSLISMHIYALHRNSAVWPDPEVFDSLRFSTENASKRHPFAFMPFSAGPRNCIGQQFAMSEMKVVTAMCLLRFEFSLDPSRLPIKMPQLVLRSKNGFHLHLKPLGPGSGK

SEQ ID NO: 757396 - protein, 512 aa, Homo sapiens; identical to SEQ ID NO: 757395

SEQ ID NO: 757397 - protein, 180 aa, Homo sapiens [sequence omitted]

SEQ ID NO: 757398 - protein, 347 aa, Homo sapiens
MRVVVIGAGVIGLSTALCIHERYHSVLQPLHIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 757399 - protein, 232 aa, Homo sapiens
MFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEVPPPTRTPFSPQPMNQCAPS

SEQ ID NO: 757400 - protein, 224 aa, Homo sapiens
MFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 757401 - protein, 103 aa, Homo sapiens
MILVEEKVEGSCPREGCDARHILPGTYTCLQATPCMSPDLPPGFWSASSRAWWVIEETQESHLRTHSLPENPMVTHFHLSDQRLFFFFFETVSFCCPGWSAVA

SEQ ID NO: 757402 - protein, 103 aa, Homo sapiens; identical to SEQ ID NO: 757401

SEQ ID NO: 757403 - protein, 103 aa, Homo sapiens; identical to SEQ ID NO: 757401

SEQ ID NO: 757404 - protein, 103 aa, Homo sapiens; identical to SEQ ID NO: 757401

SEQ ID NO: 757405 - protein, 136 aa, Homo sapiens
MILVEEKVEGSCPREGCDARHILPGTYTCLQATPCMSPDLPPGFWSASSRAWWVIEETQESHLRTHSLPENPMVTHFHLSDLWKSLVTLDVCVFEEAMGAYHDCLPPLLFRLPQLNHAVQDFWPCVHHWENVLQTG

SEQ ID NO: 757406 - protein, 361 aa, Homo sapiens
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 757407 - protein, 373 aa, Homo sapiens
MQEKDASSQGFLPQFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 757408 - protein, 102 aa, Homo sapiens
DENPSCKLGGLGNCFLNHPPRCGLRLLAPPSGQRMVVRGNYHSKRRLFMWSVYSYPVSTLSQLSATSRANLRPEVTETPGWLSGASMAASSGRVLRNFARRD

SEQ ID NO: 757409 - protein, 405 aa, Homo sapiens
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 757410 - protein, 245 aa, Homo sapiens
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKLVWIETPTNPTQKVIDIEGCAHIVHKHGDIILVVDNTFMSPYFQRPLALGADISMYSATKYMNVKAFIIDFVSCKTLLEQFHLLLIVTSAIEV

SEQ ID NO: 757411 - protein, 151 aa, Homo sapiens
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSLFGSKPPQTPPRR

SEQ ID NO: 757412 - protein, 327 aa, Homo sapiens
MASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 757413 - protein, 110 aa, Homo sapiens
GFLSDVGLCKARGASPRVLEKSWAKASRFPALRGNPLSGWPVSRPLLHVFGVALPFGCALRFCPRPFVLRPYVTAFFLETLFGPRDRTFSGFRPLCKANSGLGRAPDRGE

SEQ ID NO: 757414 - protein, 327 aa, Homo sapiens; identical to SEQ ID NO: 757412

SEQ ID NO: 757415 - protein, 124 aa, Homo sapiens
KFKRLRTDYGELPGRLRNDLGSDAIGLRMGCGNGRAGKAPGRMKGKWPPKHRGPGHGPWEVTGVSQGPVVSPRGSAGPGRWWAERTAPGWEKWGEFPLYYSCQCKTRPSRPGRLGTGPGRRHPV

SEQ ID NO: 757416 - protein, 372 aa, Homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 757417 - protein, 327 aa, Homo sapiens; identical to SEQ ID NO: 757412

SEQ ID NO: 757418 - protein, 157 aa, Homo sapiens
MNCSPPSLIRSRWQQPLEKSGPWRLPGPGLLQPQAPVAPCHPFHGSTQGGHTATASSSFPSSQTGTKDFKFWLRCSSSGCPGIQSGKPGPRVTGVGKHTCTCTHVLPESLSSRQAAALGVSALLGLTRWKPRWSDLSLGVGHLRHLTIWGRDRNGIP

SEQ ID NO: 757419 - protein, 63 aa, Homo sapiens
LDGEKGPSSEGPEEEDGEGFSFKYSPGKLRGNQYKKMMTKEELRRSRELKNNEVILSVLLKAF

SEQ ID NO: 757420 - protein, 1155 aa, Homo sapiens
HRRRVSPQAACRCALRTSTCAGHYLRARLSWLTAACCSSLALPELPDARGSRNASRRGGFGRGMGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKGCQPPPGLHHGRHTGGNTVFFVSGMTVDYTCDPGYLLVGNKSIHCMPSGNWSPSAPRCEETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRERNYYTDTSQKEAFHLEAREVYSVDPYNPAS

SEQ ID NO: 757421 - protein, 1027 aa, Homo sapiens
MISMPTKFLFYFSGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRERNYYTDTSQKEAFHLEAREVYSVDPYNPAS

SEQ ID NO: 757422 - protein, 660 aa, Homo sapiens
RGSPHDVGSLVVSDVGIPMSCRATLAATGPNVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRERNYYTDTSQKEAFHLEAREVYSVDPYNPAS

SEQ ID NO: 757423 - protein, 1096 aa, Homo sapiens
HRRRVSPQAACRCALRTSTCAGHYLRARLSWLTAACCSSLALPELPDARGSRNASRRGGFGRGMGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRERNYYTDTSQKEAFHLEAREVYSVDPYNPAS

SEQ ID NO: 757424 - protein, 894 aa, Homo sapiens
FFFLVCVCKVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRERNYYTDTSQKEAFHLEAREVYSVDPYNPAS

SEQ ID NO: 757425 - protein, 1235 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 757426 - protein, 639 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKLDLQTSQGTAEGGAPGEPQHSQAGEGRVAAAAEGAAPAVPGGGGSRAAAAAAPVL

SEQ ID NO: 757427 - protein, 971 aa, Homo sapiens
GELAADLSALFPQHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 757428 - protein, 834 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKSKELQIKKQFQETCKIQTRQYKALRAHLLETTPKAQHKSLLKRLKEEQTRKLAILAEQYDQSISEMLSSQAVRPGVQGGSALEARLCTLL

SEQ ID NO: 757429 - protein, 369 aa, Homo sapiens
ELREPEEVEVTREPGITPLHSSLATDECWGCWREAGEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 757430 - protein, 76 aa, Homo sapiens
SISASSQSSSVNSLADASDNEEEEEEEEEEEEEEEGPEAREMAMMQEGEHTVTSHSSIIHRLPVHSSPLGDPSHLL

SEQ ID NO: 757431 - protein, 1049 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKSKELQIKKQFQETCKIQTRQYKALRAHLLETTPKAQHKSLLKRLKEEQTRKLAILAEQYDQSISEMLSSQALRLDETQEAEFQALRQQLQQELELLNAYQSKIKIRTESQHERELRELEQRVALRRALLEQRVEEELLALQTGRSERIRSLLERQAREIEAFDAESMRLGFSSMALGGIPAEAAAQGYPAPPPAPAWPSRPVPRSGAHWSHGPPPPGMPPPAWRQPSLLAPPGPPNWLGPPTQSGTPRGGALLLLRNSPQPLRRAASGGSGSENVGPPAAAVPGPLSRSTSVASHILNGSSHFYS

SEQ ID NO: 757432 - protein, 1062 aa, Homo sapiens
MMGTSQGHVARKSRNWGLNPSRLSSIPLSSTPCHLSPSSLSPFSVAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 757433 - protein, 585 aa, Homo sapiens
MGTRPRAGTEAAREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 757434 - protein, 878 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTCSGDNHVDR

SEQ ID NO: 757435 - protein, 335 aa, Homo sapiens
PLVVPPLPLPPLPPPLPRCPHLPLIRPLHESKELQIKKQFQETCKIQTRQYKALRAHLLETTPKAQHKSLLKRLKEEQTRKLAILAEQYDQSISEMLSSQALRLDETQEAEFQALRQQLQQELELLNAYQSKIKIRTESQHERELRELEQRVALRRALLEQRVEEELLALQTGRSERIRSLLERQAREIEAFDAESMRLGFSSMALGGIPAEAAAQGYPAPPPAPAWPSRPVPRSGAHWSHGPPPPGMPPPAWRQPSLLAPPGPPNWLGPPTQSGTPRGGALLLLRNSPQPLRRAASGGSGSENVGPPAAAVPGPLSRSTSVASHILNGSSHFYS

SEQ ID NO: 757436 - protein, 136 aa, Homo sapiens
TLLWLNPEESREEVGRLRKPFPRRSSHCHLEVRLIEVIVHVPANLPKLPSLLHHSMKERQHVDQRLEGRVRALVQHFVRDLEVSCPHVEFQPIGWLGDNLQKRRKHTVMETAGPQAWKSVHNAGTALSFLSTEPSV

SEQ ID NO: 757437 - protein, 110 aa, Homo sapiens
CLKGSNTKVLTDLVPALSSHSTCDTLLGPTQCFNHSPRMSASFIPPSTLKPCPLAQHKEQSGLLGSKSLPPLAPTIVIICLSASQNYKLLSAWAMFCHLCISSIWPVIWY

SEQ ID NO: 757438 - protein, 482 aa, Homo sapiens
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRFTVNRRISIVGFGLYGSIHGPTDYQVNIQIIEYEKKQTLGQNDTGFSCDGTANTFRVMFKEPIEILPNVCYTACATLKGPDSHYGTKGLKKVVHETPAASKTVFFFFSSPGNNNGTSIEDGQIPEIIFYT

SEQ ID NO: 757439 - protein, 174 aa, Homo sapiens
MGYAPDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRFTVNRRISIVGFGLYGSIHGPTDYQVNIQGRNPWDP

SEQ ID NO: 757440 - protein, 275 aa, Homo sapiens
MDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRFTVNRRISIVGFGLYGSIHGPTDYQVNIQIIEYEKKQTLGQNDTGFSCDGTANTFRVMFKEPIEILPNVCYTACATLKGPDSHYGTKGLKKVVHETPAASKTVFFFFSSPGNNNGTSIEDGQIPEIIFYT

SEQ ID NO: 757441 - protein, 482 aa, Homo sapiens; identical to SEQ ID NO: 757438

SEQ ID NO: 757442 - protein, 268 aa, Homo sapiens
MGYAPDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRFTVNRRISIVGFGLYGSIHGPTDYQVNIQIIEYEKKQTLGQNDTGFSCDGTANTFRVMFKEPIEILPNVCYTACATLKGPDSHYGTKGLKKVVHETPAASKTVFFFFSSPGNNNGTSIEDGQIPEIIFYT

SEQ ID NO: 757443 - protein, 354 aa, Homo sapiens
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRQI

SEQ ID NO: 757444 - protein, 385 aa, Homo sapiens
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRSLNMRKSKPWDRMIPALVVMGQLTHSGSCSRNP

SEQ ID NO: 757445 - protein, 482 aa, Homo sapiens; identical to SEQ ID NO: 757438

SEQ ID NO: 757446 - protein, 450 aa, Homo sapiens
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRFTVNRRISIVGFGLYGSIHGPTDYQVNIQIIEYEKKQTLGQNDTGFSCDGTANTFRVMFKEPIEILPNVCYTACATLKVRVMHYVPDGFLLNVAECVF

SEQ ID NO: 757447 - protein, 404 aa, Homo sapiens
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRFTVNRRISIVGFGLYGSIHGPTDYQVNIQIIDMRKANLDRIYGLLIDAYRIL

SEQ ID NO: 757448 - protein, 482 aa, Homo sapiens; identical to SEQ ID NO: 757438

SEQ ID NO: 757449 - protein, 297 aa, Homo sapiens
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGKGINSPKSI

SEQ ID NO: 757450 - protein, 163 aa, Homo sapiens
CSAEIGDQQKASIWNFHYLQEHLSNPHALPLTQRAHCRVLSVFLVIPVGSFNSSGGSSSGTITDEDELTGILKKLSLEKYQPIFEEQEVDMEAFLTLTDGDLKELGIKTDGSRQQCAIETSKLGLVLEVSIARSEDLDYSIDKTEAGIKELQKSMVRWKNTGR

SEQ ID NO: 757451 - protein, 175 aa, Homo sapiens
CSAEIGDQQKASIWNFHYLQEHLSNPHALPLTQRAHCRVLSVFLVIPFGSFKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPSMVGWVRPEETASGKR

SEQ ID NO: 757452 - protein, 161 aa, Homo sapiens
CSAEIGDQQKASIWNFHYLQEHLSNPHALPLTQRAHCRVLSVFLVIPFGSFKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPCA

SEQ ID NO: 757453 - protein, 161 aa, Homo sapiens; identical to SEQ ID NO: 757452

SEQ ID NO: 757454 - protein, 161 aa, Homo sapiens; identical to SEQ ID NO: 757452

SEQ ID NO: 757455 - protein, 161 aa, Homo sapiens; identical to SEQ ID NO: 757452

SEQ ID NO: 757456 - protein, 174 aa, Homo sapiens
CSAEIGDQQKASIWNFHYLQEHLSNPHALPLTQRAHCRVLSVFLVIPVGSFNSSGGSSSGTITDEDELTGILKKLSLEKYQPIFEEQEVDMEAFLTLTDGDLKELGIKTDGSRQQILAAISELNAGKGRERQILQETIHNFHSSFESSASNARRAYCCPPKPCLAQCQAHHTNF

SEQ ID NO: 757457 - protein, 206 aa, Homo sapiens
MLTIFNEIDVSNIQKMRARHKEAFLKKHNLKLGFMSASVKASAFALQEQPVVNAVIDDITKEVVYRDYIDISVAVATPQGLVVPVIRNVEAMNYADIEQTITELGEKARKNEFAIEDMDGGTFTISNGGVFGSLFEHPLSTPLSAILGMHGIFDKPVAIGGKVEVQPMMYVALTYDHRLIDGREAVTFLRKIKAAVEDPRVLLFDL

SEQ ID NO: 757458 - protein, 452 aa, Homo sapiens
SRGPVLIGRGGVGSGAASALARSRPLASRLSSRRRTRAPRSGAMQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLLTPRTYCCANTEDLETVIHHVHSLYPSAPFLAAGVSMGGMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 757459 - protein, 266 aa, Homo sapiens
SRGPVLIGRGGVGSGAASALARSRPLASRLSSRRRTRAPRSGAMQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLLTPRTYCCANTEDLETVIHHVHSLYPSAPFLAAGVSMGG

SEQ ID NO: 757460 - protein, 149 aa, Homo sapiens
SRGPVLIGRGGVGSGAASALARSRPLASRLSSRRRTRAPRSGAMQRLAMDLRMLSRELSLYLEHQVRVGFFGSGVGLSLILGFSVAYAFYYLSSIAKKPQLVTGGESFSRFLQDHCPVVTETYHQTYYLIVAWPHGNKQGVIYPSYDPS

SEQ ID NO: 757461 - protein, 399 aa, Homo sapiens
SRGPVLIGRGGVGSGAASALARSRPLASRLSSRRRTRAPRSGAMQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 757462 - protein, 266 aa, Homo sapiens; identical to SEQ ID NO: 757459

SEQ ID NO: 757463 - protein, 215 aa, Homo sapiens
SRGPVLIGRGGVGSGAASALARSRPLASRLSSRRRTRAPRSGAMQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRYQ

SEQ ID NO: 757464 - protein, 196 aa, Homo sapiens
SRGPVLIGRGGVGSGAASALARSRPLASRLSSRRRTRAPRSGAMQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNNSTCYMDASTRPTILLLPGLTGTSKESYILHMIHLSEELGYRYQ

SEQ ID NO: 757465 - protein, 154 aa, Homo sapiens
MTFITPVTEIITYCSLQLQWPSKLFFPRMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNAMIAFRP

SEQ ID NO: 757466 - protein, 189 aa, Homo sapiens [sequence omitted]

SEQ ID NO: 757467 - protein, 214 aa, Homo sapiens
MTFITPVTEIITYCSLQLQWPSKLFFPRMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 757468 - protein, 266 aa, Homo sapiens; identical to SEQ ID NO: 757459

SEQ ID NO: 757469 - protein, 215 aa, Homo sapiens; identical to SEQ ID NO: 757463

SEQ ID NO: 757470 - protein, 1585 aa, Homo sapiens
MNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 757471 - protein, 1642 aa, Homo sapiens
MNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNELLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 757472 - protein, 1797 aa, Homo sapiens
AAAAAVPPPHPNIRALQTQAPQQIPRGPVQQPLEDRIFTPAVSAVYSTVTQVARQPGTPTPSPYSAHEINKGHPNLAATPPGHASSPGLSQTPYPSGQNAGPTTLVYPQTPQTMNSQPQTRSPFFGQPSRTVPIHCTDNWKRRKVLEQTPVYRSLAGRGWIKYCIFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNELLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 757473 - protein, 1261 aa, Homo sapiens
CSTPCTRSLPIISNSCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 757474 - protein, 1128 aa, Homo sapiens
MLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 757475 - protein, 1642 aa, Homo sapiens; identical to SEQ ID NO: 757471

SEQ ID NO: 757476 - protein, 1593 aa, Homo sapiens
MNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNELLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIDLLRMFFDCLYDEEVISEDAFYKWESSKDPAEQNGKGVALKSVTAFFTWLREAEEESEDN

SEQ ID NO: 757477 - protein, 302 aa, Homo sapiens
REEGEVGWAAGPQACFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 757478 - protein, 219 aa, Homo sapiens
LVLDRERTLASRADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 757479 - protein, 986 aa, Homo sapiens
MNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNELLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHVLYLFQTPSGNGSVYLPG

SEQ ID NO: 757480 - protein, 775 aa, Homo sapiens
MNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNELLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPP

SEQ ID NO: 757481 - protein, 464 aa, Homo sapiens
MTAHYKGECSNFITIPQSIDEETEVWSDHIIFPRIPRGPVQQPLEDRIFTPAVSAVYSTVTQVARQPGTPTPSPYSAHEINKGHPNLAATPPGHASSPGLSQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPGLVANRGLVANRGLVANRGLVANRGLVANRGLVANRGL

SEQ ID NO: 757482 - protein, 258 aa, Homo sapiens
AAAAAVPPPHPNIRALQTQAPQQIPRGPVQQPLEDRIFTPAVSAVYSTVTQVARQPGTPTPSPYSAHEINKGHPNLAATPPGHASSPGLSQTPYPSGQNAGPTTLVYPQTPQTMNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPCDAAANLVVVGG

SEQ ID NO: 757483 - protein, 106 aa, Homo sapiens
AAAAAVPPPHPNIRALQTQAPQQIPRGPVQQPLEDRIFTPAVSAVYSTVTQVARQPGTPTPSPYSAHEINKGHPNLAATPPGHASSPGLSQTPYPSGDSSLLIEPT

SEQ ID NO: 757484 - protein, 1744 aa, Homo sapiens
AAAAAVPPPHPNIRALQTQAPQQIPRGPVQQPLEDRIFTPAVSAVYSTVTQVARQPGTPTPSPYSAHEINKGHPNLAATPPGHASSPGLSQTPYPSGQNAGPTTLVYPQTPQTMNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNELLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 757485 - protein, 1642 aa, Homo sapiens; identical to SEQ ID NO: 757471

SEQ ID NO: 757486 - protein, 988 aa, Homo sapiens [sequence omitted]

SEQ ID NO: 757487 - protein, 1642 aa, Homo sapiens; identical to SEQ ID NO: 757471

SEQ ID NO: 757488 - protein, 350 aa, Homo sapiens
MSEVEEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 757489 - protein, 1535 aa, Homo sapiens
MNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNELLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIGK

SEQ ID NO: 757490 - protein, 761 aa, Homo sapiens
MNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNELLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPVSASSLQLT

SEQ ID NO: 757491 - protein, 515 aa, Homo sapiens
MNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNEC

SEQ ID NO: 757492 - protein, 134 aa, Homo sapiens
AAAAAVPPPHPNIRALQTQAPQQIPRGPVQQPLEDRIFTPAVSAVYSTVTQVARQPGTPTPSPYSAHEINKGHPNLAATPPGHASSPGLSQNAGPTTLVYPQTPQTMNSQPQTRSPVSKQKLEPNYILYLCLCV

SEQ ID NO: 757493 - protein, 125 aa, Homo sapiens
LCFPGKLSLDRTSFWFSHYAACKAEINQWPHVCGQDLLQGILSVNIDESLLGGIGFLSTHLAPSSVGTTQLSVLSHIIYLIAISKRKGRVNPAHQMLQACDRIPSILVVFAAFSSSPLVTDQCFP

SEQ ID NO: 757494 - protein, 108 aa, Homo sapiens
KADQASAPPRAGKVCKPPYPGDLGLLESPIQPPPSTLVWPGSYSLPGFGWTWLVWDDPLSPNRCGMWGAWWWVTLPTAIFTDSKGGSTRLCPGRPATGQTGSLWTCRQ

SEQ ID NO: 757495 - protein, 391 aa, Homo sapiens
HSPGREAELGGRDLRAAVSPAERQELRTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEQKKIFTIQGCYPVIRCLLRRRGWVEKKMAIAPGPTLLPPQKDLDSSAMGDSDTTEDEDEDEDEEFQPVTSCSDFDDLTRTLMTYAGTHASDMVGLCSQSPDFGPWICIRLIANSLPPQTAMALAGLSDDNSSLHLGRHSGPGNRTHNTRVEGPRIRREHAREACEERTYTTGTKGKRQRPAETENRPRRLSTHPTSRKSAQRANQSARTHAQKHPAHKGPNQRAPSATKTEEQTQNATLSEKHSHREPGTHTPSQ

SEQ ID NO: 757496 - protein, 194 aa, Homo sapiens
HSPGREAELGGRDLRAAVSPAERQELRTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 757497 - protein, 106 aa, Homo sapiens
HSPGREAELGGRDLRAAVSPAERQELRTATLRPYLSAVRATLQAALCLENFSSQVVERHNKPEVEVRSSKELLLQPVTISRNEKEKVLIEGSINSVRVSIAVKQGV

SEQ ID NO: 757498 - protein, 106 aa, Homo sapiens; identical to SEQ ID NO: 757497

SEQ ID NO: 757499 - protein, 181 aa, Homo sapiens
LPYFRFPAQPAPAMTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 757500 - protein, 121 aa, Homo sapiens [sequence omitted]

SEQ ID NO: 757501 - protein, 129 aa, Homo sapiens [sequence omitted]

SEQ ID NO: 757502 - protein, 248 aa, Homo sapiens
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEFEDIVGDWYFHHQEQPLQNFLCEGHVLPAAETACLQETWTGKEITDGEEKTEGEEEQEEEEEEEEEEGGDKMTKTGSHPKLDREDL

SEQ ID NO: 757503 - protein, 248 aa, Homo sapiens; identical to SEQ ID NO: 757502

SEQ ID NO: 757504 - protein, 248 aa, Homo sapiens; identical to SEQ ID NO: 757502

SEQ ID NO: 757505 - protein, 228 aa, Homo sapiens [sequence omitted]

SEQ ID NO: 757506 - protein, 157 aa, Homo sapiens
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQVG

SEQ ID NO: 757507 - protein, 455 aa, Homo sapiens
MVRELLREPAGLSLVLKKIPIPETPPQTPPQVLDSPHQRSPSLSLAPLSPRAPSEDVFAFDLSSNPSPGPSPAWTDSASLGPEPLPIPPEPPAILPAGVAGTPGLPESPDKSPVGRKKSKGLATRLSRRRVSCRELGRPDCDGWLLLRKAPGGFMGPRWRRRWFVLKGHTLYWYRQPQDEKAEGLINVSNYSLESGHDQKKKYVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDSTEQSPHSLPSDPEEHSHLCPLTSESSLRPPDL

SEQ ID NO: 757508 - protein, 141 aa, Homo sapiens [sequence omitted]

SEQ ID NO: 757509 - protein, 708 aa, Homo sapiens
NSGDSRGKTGADSSWQSWAMEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDGPAAEKEGTVLRICSHVAGICHNILVCCPKELLEQKAVLEQVQLDSPLGLEIHTTSNCQHFVSQVDTQVPTDSRLQIQPGDEVVQINEQVVVGWPRKNMVRELLREPAGLSLVLKKIPIPETPPQTPPQVLDSPHQRSPSLSLAPLSPRAPSEDVFAFDLSSNPSPGPSPAWTDSASLGPEPLPIPPEPPAILPAGVAGTPGLPESPDKSPVGRKKSKGLATRLSRRRVSCRELGRPDCDGWLLLRKAPGGFMGPRWRRRWFVLKGHTLYWYRQPQDEKAEGLINVSNYSLESGHDQKKKYVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDLKSTPISAP

SEQ ID NO: 757510 - protein, 732 aa, Homo sapiens
NSGDSRGKTGADSSWQSWAMEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDGPAAEKEGTVLRICSHVAGICHNILVCCPKELLEQKAVLEQVQLDSPLGLEIHTTSNCQHFVSQVDTQVPTDSRLQIQPGDEVVQINEQVVVGWPRKNMVRELLREPAGLSLVLKKIPIPETPPQTPPQVLDSPHQRSPSLSLAPLSPRAPSEDVFAFDLSSNPSPGPSPAWTDSASLGPEPLPIPPEPPAILPAGVAGTPGLPESPDKSPVGRKKSKGLATRLSRRRVSCRELGRPDCDGWLLLRKAPGGFMGPRWRRRWFVLKGHTLYWYRQPQDEKAEGLINVSNYSLESGHDQKKKYVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDSTEQSPHSLPSDPEEHSHLCPLTSESSLRPPDL

SEQ ID NO: 757511 - protein, 739 aa, Homo sapiens
NSGDSRGKTGADSSWQSWAMEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDGPAAEKEGTVLRICSHVAGICHNILVCCPKELLEQKAVLEQVQLDSPLGLEIHTTSNCQHFVSQVDTQVPTDSRLQIQPGDEVVQINEQVVVREERDMVGWPRKNMVRELLREPAGLSLVLKKIPIPETPPQTPPQVLDSPHQRSPSLSLAPLSPRAPSEDVFAFDLSSNPSPGPSPAWTDSASLGPEPLPIPPEPPAILPAGVAGTPGLPESPDKSPVGRKKSKGLATRLSRRRVSCRELGRPDCDGWLLLRKAPGGFMGPRWRRRWFVLKGHTLYWYRQPQDEKAEGLINVSNYSLESGHDQKKKYVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDSTEQSPHSLPSDPEEHSHLCPLTSESSLRPPDL

SEQ ID NO: 757512 - protein, 259 aa, Homo sapiens
LGRYKVCVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDSTEQSPHSLPSDPEEHSHLCPLTSESSLRPPDL

SEQ ID NO: 757513 - protein, 119 aa, Homo sapiens
MRGPGPSRPLLAPSFSTPTPISVQGKGCGGLCWGNGGRQVGRRRPASGKSVEYEKYFKLKCLKFTKTEIGTCVLSSSTTLSFLHCRLPVFAFVLLPDSILYHRGGTTDNRRQGKTKEFI

SEQ ID NO: 757514 - protein, 300 aa, Homo sapiens
MGRAREVGWMAAGLMIGAGACYCVYKLTIGRDDSEKLEEEGEEEWDDDQELDEEEPDIWFDFETMARPWTEDGDWTEPGAPGGTEDRPSGGGKANRAHPIKQRPFPYEHKNTWSAQNCKNGSCVLDLSKCLFIQGKLLFAEPKDAGFPFSQDINSHLASLSMARNTSPTPDPTVREALCAPDNLNASIESQGQIKMYINEVCRETVSRCCNSFLQQAGLNLLISMTVINNMLAKSASDLKFPLISEGSGCAKVQVLKPLMGLSEKPVLAGELVGAQMLFSFMSLFIRNGNREILLETPAP

SEQ ID NO: 757515 - protein, 300 aa, Homo sapiens; identical to SEQ ID NO: 757514

SEQ ID NO: 757516 - protein, 294 aa, Homo sapiens
MAAGLMIGAGACYCVYKLTIGRDDSEKLEEEGEEEWDDDQELDEVFITVVKMHNAREARQGSYRNKHTGLNGGQCLKNPGEQARNTKTAHKTHITQRPFPYEHKNTWSAQNCKNGSCVLDLSKCLFIQGKLLFAEPKDAGFPFSQDINSHLASLSMARNTSPTPDPTVREALCAPDNLNASIESQGQIKMYINEVCRETVSRCCNSFLQQAGLNLLISMTVINNMLAKSASDLKFPLISEGSGCAKVQVLKPLMGLSEKPVLAGELVGAQMLFSFMSLFIRNGNREILLETPAP

SEQ ID NO: 757517 - protein, 300 aa, Homo sapiens; identical to SEQ ID NO: 757514

SEQ ID NO: 757518 - protein, 119 aa, Homo sapiens; identical to SEQ ID NO: 757513

SEQ ID NO: 757519 - protein, 300 aa, Homo sapiens; identical to SEQ ID NO: 757514

SEQ ID NO: 757520 - protein, 300 aa, Homo sapiens; identical to SEQ ID NO: 757514

SEQ ID NO: 757521 - protein, 170 aa, Homo sapiens
MTELQSALLLRRQLAELNKNPVEGFSAGLIDDNDLYRWEVLIIGPPDTLYEGGVFKAHLTFPKDYPLRPPKMKFITEIWHPNVDKNGDVCISILHEPGEDKYGYEKPEERWLPIHTVETIMISVISMLADPNGDSPANVDAAKEWREDRNGEFKRKVARCVRKSQETAFE

SEQ ID NO: 757522 - protein, 170 aa, Homo sapiens; identical to SEQ ID NO: 757521

SEQ ID NO: 757523 - protein, 170 aa, Homo sapiens; identical to SEQ ID NO: 757521

SEQ ID NO: 757524 - protein, 170 aa, Homo sapiens; identical to SEQ ID NO: 757521

SEQ ID NO: 757525 - protein, 170 aa, Homo sapiens; identical to SEQ ID NO: 757521

SEQ ID NO: 757526 - protein, 192 aa, Homo sapiens
GAASVRCQRRQTRMLWPLSQVKKASREERSAVSKKSWELNKNPVEGFSAGLIDDNDLYRWEVLIIGPPDTLYEGGVFKAHLTFPKDYPLRPPKMKFITEIWHPNVDKNGDVCISILHEPGEDKYGYEKPEERWLPIHTVETIMISVISMLADPNGDSPANVDAAKEWREDRNGEFKRKVARCVRKSQETAFE

SEQ ID NO: 757527 - protein, 170 aa, Homo sapiens; identical to SEQ ID NO: 757521

SEQ ID NO: 757528 - protein, 170 aa, Homo sapiens; identical to SEQ ID NO: 757521

SEQ ID NO: 757529 - protein, 170 aa, Homo sapiens; identical to SEQ ID NO: 757521

SEQ ID NO: 757530 - protein, 170 aa, Homo sapiens; identical to SEQ ID NO: 757521

SEQ ID NO: 757531 - protein, 170 aa, Homo sapiens; identical to SEQ ID NO: 757521

SEQ ID NO: 757532 - protein, 165 aa, Homo sapiens
ISLPPSLQLLKLNKNPVEGFSAGLIDDNDLYRWEVLIIGPPDTLYEGGVFKAHLTFPKDYPLRPPKMKFITEIWHPNVDKNGDVCISILHEPGEDKYGYEKPEERWLPIHTVETIMISVISMLADPNGDSPANVDAAKEWREDRNGEFKRKVARCVRKSQETAFE

SEQ ID NO: 757533 - protein, 107 aa, Homo sapiens
MTMISTDGKSLLLALQIHFIDKNGDVCISILHEPGEDKYGYEKPEERWLPIHTVETIMISVISMLADPNGDSPANVDAAKEWREDRNGEFKRKVARCVRKSQETAFE

SEQ ID NO: 757534 - protein, 106 aa, Homo sapiens
MPPCSCARSLCALQVLLLTVLGSSTNGQTKRNIGKRKCRDLFLAPVAASAIPVSGRKTGLVLLGLESAIITTNPSGGVTERGHFTFAGHSAGHFTKALQIIFTMAL

SEQ ID NO: 757535 - protein, 226 aa, Homo sapiens
MKVLILACLVALALARETIESLSSSEESITEYKQKVEKVKHEDQQQGEDEHQDKIYPSFQPQPLIYPFVEPIPYGFLPQNILPLAQPAVVLPVPQPEIMEVPKAKDTVYTKGRVMPVLKSPTIPFFDPQIPKLTDLENLHLPLPLLQPLMQQVPQPIPQTLALPPQPLWSVPQPKVLPIPQQVVPYPQRAVPVQALLLNQELLLNPTHQIYPVTQPLAPVHNPISV

SEQ ID NO: 757536 - protein, 716 aa, Homo sapiens
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVVAGMNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSLPFIPFGGPRRNKEIMYRITTEKPAGAIAGAQRRENGPLEWSYTLPITCQLSLGLQSQLVPILANILEVEQAKCWGFDQFFAETSDILQRVVVHVFSLSQAVLHHIYIHAHNTIAIFQEAVHKQTSVAPRHQEYLFEGHLCVLEPSVSAQHIAHTTASSPLTLFSTAIPKGLAFRDPALDVPKFVPKVDLQADYNTAKGVLGAGYQALRLARALLDGQELMFRGLHWVMEVLQATCRRTLEVARTSLLYLSSSLGTERFSSVAGTPEIQELKAAAELRSRLRTLAEVLSRCSQNITETQESLSSLNRELVKSRDQVHEDRSIQQIQCCLDKMNFIYKQFKKSRMRPGLGYNEEQIHKLDKVNFSHLAKRLLQVFQEECVQKYQASLVTHGKRMRVVHETRNHLRLVGCSVAACNTEAQGVQESLSKLLEELSHQLLQDRAKGAQASPPPIAPYPSPTRKDLLLHMQELCEGMKLLASDLLDNNRIIERLNRVPAPPDV

SEQ ID NO: 757537 - protein, 594 aa, Homo sapiens
MNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSLPFIPFGGPRRNKEIMYRITTEKPAGAIAGAQRRENGPLEWSYTLPITCQLSLGLQSQLVPILANILEVEQAKCWGFDQFFAETSDILQRVVVHVFSLSQAVLHHIYIHAHNTIAIFQEAVHKQTSVAPRHQEYLFEGHLCVLEPSVSAQHIAHTTASSPLTLFSTAIPKGLAFRDPALDVPKFVPKVDLQADYNTAKGVLGAGYQALRLARALLDGQELMFRGLHWVMEVLQATCRRTLEVARTSLLYLSSSLGTERFSSVAGTPEIQELKAAAELRSRLRTLAEVLSRCSQNITETQESLSSLNRELVKSRDQVHEDRSIQQIQCCLDKMNFIYKQFKKSRMRPGLGYNEEQIHKLDKVNFSHLAKRLLQVFQEECVQKYQASLVTHGKRMRVVHETRNHLRLVGCSVAACNTEAQGVQESLSKLLEELSHQLLQDRAKGAQASPPPIAPYPSPTRKDLLLHMQELCEGMKLLASDLLDNNRIIERLNRVPAPPDV

SEQ ID NO: 757538 - protein, 280 aa, Homo sapiens
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVVAGMNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSSIYKLTDFGAARELDDDEKFVSVYGTEEYLHPDMYDRAVLRKPQQKAFGVTVDLWSTWSRLS

SEQ ID NO: 757539 - protein, 153 aa, Homo sapiens
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVGEPLPVPASTLRPAAGLGQMLTGLRCLTPANHSI

SEQ ID NO: 757540 - protein, 93 aa, Homo sapiens
GGPGESQQGGHGRRILGALGMQAGALVTHVFPSSSTPPTQPHISWLLIADQSMASLQLLEELSHQLLQDRAKGAQASPPPIAPYPSPTRKDLL

SEQ ID NO: 757541 - protein, 716 aa, Homo sapiens; identical to SEQ ID NO: 757536

SEQ ID NO: 757542 - protein, 476 aa, Homo sapiens
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVVAGMNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSLPFIPFGGPRRNKEIMYRITTEKPAGAIAGAQRRENGPLEWSYTLPITCQLSLGLQSQLVPILANILEVEQAKCWGFDQFFAETSDILQRVVVHVFSLSQAVLHHIYIHAHNTIAIFQEAVHKQTSVAPRHQEYLFEGHLCVLEPSVSAQHIAHTTASSPLTLFSTAIPKGLAFRDPALDVPKFVPKVDLQADYNTAKGVLGAGYQALRLARALLDGQELMFRGLHWVMEVLQATCRRTLEVARTSLLYLSSSLGTER

SEQ ID NO: 757543 - protein, 74 aa, Homo sapiens
LLPTTAVSRIAIFQEAVHKQTSVAPRHQEYLFEGHLCVLEPSVSAQHIAHTTASSPLTLFSTAIPKGLAFRDRE

SEQ ID NO: 757544 - protein, 48 aa, Homo sapiens
MPQLHYGEEVRQSPQQAPDPSALHQGGPWACAHSTNVPSRADHSGWQR

SEQ ID NO: 757545 - protein, 187 aa, Homo sapiens
EGFYFYMLKCAEDDTNEEQTTFTNSQTSTEDPGDSTPFEDSEEFCFSAEANSFDGDDEFDTYNEDDEEDESETGYWITCCPTCDVDINTWVPFYSTELNKPAMIYCSHGDGHWVHAQCMDLAERTLIHLSAGSNKYYCNEHVEIARALHTPQRVLPLKKPPMKSLRKKGSGKILTPAKKSFLRRLFD

SEQ ID NO: 757546 - protein, 43 aa, Homo sapiens
RDWLALPSAPYNSTDKTTQIPAGYSGSRLFSQHCSRLRWEDHL

SEQ ID NO: 757547 - protein, 171 aa, Homo sapiens
ESEKSLENETLNKEEDCHSPTSKPPKPDQPLKVMPAPPPKENAWVKRSSNPPARSQSSDTEQQSPTSGGGKVAPAQPSEEGPGRKDENKVDGMNVPKGQTGNSSRGPGDGGNRDHWKESDRKDGKKDQDSRSAPEPKKPEENPASKFSSASKYAALSVDGEDENEGEDYAE

SEQ ID NO: 757548 - protein, 135 aa, Homo sapiens
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGKSSFQVQFCKQVCCSLC

SEQ ID NO: 757549 - protein, 869 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 757550 - protein, 213 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEALLR

SEQ ID NO: 757551 - protein, 234 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEGAKGIHTQFVASALQLRSFLSCPQI

SEQ ID NO: 757552 - protein, 189 aa, Homo sapiens [sequence omitted]

SEQ ID NO: 757553 - protein, 404 aa, Homo sapiens
MTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 757554 - protein, 202 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRGTSLAGLACLRHLLEQHSPLHLSQILHHAIVYTLLCNLRS

SEQ ID NO: 757555 - protein, 691 aa, Homo sapiens
MDGCKKELPRLQEPEEDEDCYILNVQSSSDDTSGSSVARRAPKRQASCILNVQSRSGDTSGSSVARRAPKRQASSVVVIDSDSDEECHTHEEKKAKLLEINSDDESPECCHVKPAIQEPPIVISDDDNDDDNGNDLEVPDDNSDDSEAPDDNSDDSEAPDDNSDDSEAPDDNSDDSEAPDDNSDDSDVPDDNSDDSSDDNSDDSSDDNSDDSDVPDDKSDDSDVPDDSSDDSDVPDDSSDDSEAPDDSSDDSEAPDDSSDDSEAPDDSSDDSEAPDDSSDDSEASDDSSDDSEASDDSSDDSEAPDDKSDDSDVPEDKSDDSDVPDDNSDDLEVPVPAEDLCNEGQIASDEEELVEAAAAVSQHDSSDDAGEQDLGENLSKPPSDPEANPEVSERKLPTEEEPAPVVEQSGKRKSKTKTIVEPPRKRQTKTKNIVEPPRKRQTKTKNIVEPLRKRKAKTKNVSVTPGHKKRGPSKKKPGAAKVEKRKTRTPKCKVPGCFLQDLEKSKKYSGKNLKRNKDELVQRIYDLFNRSVCDKKLPEKLRIGWNNKMVKTAGLCSTGEMWYPKWRRFAKIQIGLKVCDSADRIRDTLIHEMCHAASWLIDGIHDSHGDAWKYYARKSNRIHPELPRVTRCHNYKINYKVHYECTGCKTRIGCYTKSLDTSRFICAKCKGSLVMVPLTQKDGTRIVPHV

SEQ ID NO: 757556 - protein, 652 aa, Homo sapiens
MDGCKKELPRLQEPEEDEDCYILNVQSSSDDTSGSSVARRAPKRQASCILNVQSRSGDTSGSSVARRAPKRQASSVVVIDSDSDEECHTHEEKKAKLLEINSDDESPECCHVKPAIQEPPIVISDDDNDDDNGNDLEVPDDNSDDSEAPDDNSDDSEAPDDNSDDSEAPDDNSDDSEAPDDNSDDSDVPDDNSDDSSDDNSDDSSDDNSDDSDVPDDKSDDSDVPDDSSDDSDVPDDSSDDSEAPDDSSDDSEAPDDSSDDSEAPDDSSDDSEAPDDSSDDSEASDDSSDDSEASDDSSDDSEAPDDKSDDSDVPEDKSDDSDVPDDNSDDLEVPVPAEDLCNEGQIASDEEELVEAAAAVSQHDSSDDAGEQDLGENLSKPPSDPEANPEVSERKLPTEEEPAPVVEQSGKRKSKTKTIVEPPRKRQTKTKNIVEPPRKRQTKTKNIVEPLRKRKAKTKNVSVTPGHKKRGPSKKKPGAAKVEKRKTRTPKCKVPGCFLQDLEKSKKYSGKNLKRNKDELVQRIYDLFNRSVCDKKLPEKLRIGWNNKMVKTAGLCSTGEMWYPKWRRFAKIQIGLKVCDSADRIRDTLIHEMCHAASWLIDGIHDSHGDAWKYYARKSNRIHPELPRVTRCHNYKINYKVHYECTGCKTR

SEQ ID NO: 757557 - protein, 80 aa, Homo sapiens
TLKKRSFLLELLQKQTHERLSCHNQGIASVNESNREHSTARRLPPRLNGMIGTSCSRFPLELVPQSDFSIIMSQLIPLYD

SEQ ID NO: 757558 - protein, 373 aa, Homo sapiens
MEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRLMSGPVPPSACSPRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 757559 - protein, 359 aa, Homo sapiens
MEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 757560 - protein, 366 aa, Homo sapiens
MEQIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 757561 - protein, 364 aa, Homo sapiens [sequence omitted]

SEQ ID NO: 757562 - protein, 382 aa, Homo sapiens
SLRSLGPDRPAGKMRLKNQIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 757563 - protein, 373 aa, Homo sapiens; identical to SEQ ID NO: 757558

SEQ ID NO: 757564 - protein, 397 aa, Homo sapiens
QPLGCVHGGKGLTDMRLLLLREIVINESRNCSFMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 757565 - protein, 371 aa, Homo sapiens
MEWNGLKMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 757566 - protein, 263 aa, Homo sapiens
MEWNGLKMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKR

SEQ ID NO: 757567 - protein, 54 aa, Homo sapiens
DEISIPLGPKHLHMTQAEMQKEAHQRQADMQEIALWRTGHIRDNTLTRTHTQRK

SEQ ID NO: 757568 - protein, 95 aa, Homo sapiens
LEDPPKVHSSISTKDKNVMMSARTLIHLFRTLNPQMLQKKFRGKPTEASIEARVQEYGELDAKDYIPGAEVLEVEKEENAENDEDGMGNDHAARR

SEQ ID NO: 757569 - protein, 687 aa, Homo sapiens
MSNRNNNKLPSNLPQLQNLIKRDPPAYIEEFLQQYNHYKSNVEIFKLQPNKPSKELAELVMFMAQISHCYPEYLSNFPQEVKDLLSCNHTVLDPDLRMTFCKALILLRNKNLINPSSLLELFFELFRCHDKLLRKTLYTHIVTDIKNINAKHKNNKVNVVLQNFMYTMLRDSNATAAKMSLDVMIELYRRNIWNDAKTVNVITTACFSKVTKILVAALTFFLGKDEDEKQDSDSESEDDGPTARDLLVQYATGKKSSKNKKKLEKAMKVLKKQKKKKKPEVFNFSAIHLIHDPQDFAEKLLKQLECCKERFEVKMMLMNLISRLVGIHELFLFNFYPFLQRFLQPHQREVTKILLFAAQASHHLVPPEIIQSLLMTVANNFVTDKNSGEVMTVGINAIKEITARCPLAMTEELLQDLAQYKTHKDKNVMMSARTLIHLFRTLNPQMLQKKFRGKPTEASIEARVQEYGELDAKDYIPGAEVLEVEKEENAENDEDGWESTSLSEEEDADGEWIDVQHSSDEEQQEISKKLNSMPMEERKAKAAAISTSRVLTQEDFQKIRMAQMRKELDAAPGKSQKRKYIEIDSDEEPRGELLSLRDIERLHKKPKSDKETRLATAMAGKTDRKEFVRKKTKTNPFSSSTNKEKKKQKNFMMMRYSQNVRSKNKRSFREKQLALRDALLKKRKRMK

SEQ ID NO: 757570 - protein, 702 aa, Homo sapiens
MSNRNNNKLPSNLPQLQNLIKRDPPAYIEEFLQQYNHYKSNVEIFKLQPNKPSKELAELVMFMAQEEKESNFRRAFALLQISHCYPEYLSNFPQEVKDLLSCNHTVLDPDLRMTFCKALILLRNKNLINPSSLLELFFELFRCHDKLLRKTLYTHIVTDIKNINAKHKNNKVNVVLQNFMYTMLRDSNATAAKMSLDVMIELYRRNIWNDAKTVNVITTACFSKVTKILVAALTFFLGKDEDEKQDSDSESEDDGPTARDLLVQYATGKKSSKNKKKLEKAMKVLKKQKKKKKPEVFNFSAIHLIHDPQDFAEKLLKQLECCKERFEVKMMLMNLISRLVGIHELFLFNFYPFLQRFLQPHQREVTKILLFAAQASHHLVPPEIIQSLLMTVANNFVTDKNSGEVMTVGINAIKEITARCPLAMTEELLQDLAQYKTHKDKNVMMSARTLIHLFRTLNPQMLQKKFRGKPTEASIEARVQEYGELDAKDYIPGAEVLEVEKEENAENDEDGWESTSLSEEEDADGEWIDVQHSSDEEQQEISKKLNSMPMEERKAKAAAISTSRVLTQEDFQKIRMAQMRKELDAAPGKSQKRKYIEIDSDEEPRGELLSLRDIERLHKKPKSDKETRLATAMAGKTDRKEFVRKKTKTNPFSSSTNKEKKKQKNFMMMRYSQNVRSKNKRSFREKQLALRDALLKKRKRMK

SEQ ID NO: 757571 - protein, 687 aa, Homo sapiens; identical to SEQ ID NO: 757569

SEQ ID NO: 757572 - protein, 421 aa, Homo sapiens
MKVLKKQKKKKKPEVFNFSAIHLIHDPQDFAEKLLKQLECCKERFEVKMMLMNLISRLVGIHELFLFNFYPFLQRFLQPHQREVTKILLFAAQASHHLVPPEIIQSLLMTVANNFVTDKNSGEVMTVGINAIKEITARCPLAMTEELLQDLAQYKTHKDKNVMMSARTLIHLFRTLNPQMLQKKFRGKPTEASIEARVQEYGELDAKDYIPGAEVLEVEKEENAENDEDGWESTSLSEEEDADGEWIDVQHSSDEEQQEISKKLNSMPMEERKAKAAAISTSRVLTQEDFQKIRMAQMRKELDAAPGKSQKRKYIEIDSDEEPRGELLSLRDIERLHKKPKSDKETRLATAMAGKTDRKEFVRKKTKTNPFSSSTNKEKKKQKNFMMMRYSQNVRSKNKRSFREKQLALRDALLKKRKRMK

SEQ ID NO: 757573 - protein, 249 aa, Homo sapiens
MSNRNNNKLPSNLPQLQNLIKRDPPAYIEEFLQQYNHYKSNVEIFKLQPNKPSKELAELVMFMAQISHCYPEYLSNFPQEVKDLLSCNHTVLDPDLRMTFCKALILLRNKNLINPSSLLELFFELFRCHDKLLRKTLYTHIVTDIKNINAKHKNNKVNVVLQNFMYTMLRDSNATAAKMSLDVMIELYRRNIWNDAKTVNVITTACFSKVTKILVAALTFFLGKDEDEKQDSDSESEDDGPTARDLLVQ

SEQ ID NO: 757574 - protein, 505 aa, Homo sapiens
MSNRNNNKLPSNLPQLQNLIKRDPPAYIEEFLQQYNHYKSNVEIFKLQPNKPSKELAELVMFMAQISHCYPEYLSNFPQEVKDLLSCNHTVLDPDLRMTFCKALILLRNKNLINPSSLLELFFELFRCHDKLLRKTLYTHIVTDIKNINAKHKNNKVNVVLQNFMYTMLRDSNATAAKMSLDVMIELYRRNIWNDAKTVNVITTACFSKVTKILVAALTFFLGKDEDEKQDSDSESEDDGPTARDLLVQYATGKKSSKNKKKLEKAMKVLKKQKKKKKPEVFNFSAIHLIHDPQDFAEKLLKQLECCKERFEVKMMLMNLISRLVGIHELFLFNFYPFLQRFLQPHQREVTKILLFAAQASHHLVPPEIIQSLLMTVANNFVTDKNSGEVMTVGINAIKEITARCPLAMTEELLQDLAQYKTHKDKNVMMSARTLIHLFRTLNPQMLQKKFRGKPTEASIEARVQEYGELDAKDYIPGAEVLEVEKEENAENDEDGMGNDHAARR

SEQ ID NO: 757575 - protein, 147 aa, Homo sapiens
MSNRNNNKLPSNLPQLQNLIKRDPPAYIEEFLQQYNHYKSNVEIFKLQPNKPSKELAELVMFMAQISHCYPEYLSNFPQEVKDLLSCNHTVLDPDLRMTFCKALILLRNKNLINPSSLLELFFELFRCHDKLLRKVKGKTNISLHLP

SEQ ID NO: 757576 - protein, 193 aa, Homo sapiens [sequence omitted]

SEQ ID NO: 757577 - protein, 113 aa, Homo sapiens
MDHLGASLWPQVGSLCLLLAGAAWAPPPNLPDPKFESKAALLAARGPEELLCFTERLEDLVCFWEEAASAGVGPGNYSFSYQLELSPIRRVPPRAEGGGGAELPGGRSLVCPL

SEQ ID NO: 757578 - protein, 508 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 757579 - protein, 571 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRGTVFLSPDWLSSTRARPHVIYFCLLRVPRPDSSPQVEILEGRTECVLSNLRGRTRYTFAVRARMAEPSFGGFWSAWSEPVSLLTPSGEAPGGGVGGARANHGASPPPCPPPRLLDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 757580 - protein, 540 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQVGGLVVPSVPGLPCFSAAKLQASLSRLVLFLQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 757581 - protein, 577 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRGTVFLSPDWLSSTRARPHVIYFCLLRVPRPDSSPQVEILEGRTECVLSNLRGRTRYTFAVRARMAEPSFGGFWSAWSEPVSLLTPSGEAPGGGVGGARANHGASPPPCPPPRLLDLDPLILTLSLILVVILVLLTVLALLSHRRALKQKIWPGIPSPESEFEGLFTTHKGNFQVVLFLQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 757582 - protein, 167 aa, Homo sapiens [sequence omitted]

SEQ ID NO: 757583 - protein, 508 aa, Homo sapiens; identical to SEQ ID NO: 757578

SEQ ID NO: 757584 - protein, 543 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRGTVFLSPDWLSSTRARPHVIYFCLLRVPRPDSSPQVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 757585 - protein, 603 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRGTVFLSPDWLSSTRARPHVIYFCLLRVPRPDSSPQVEILEGRTECVLSNLRGRTRYTFAVRARMAEPSFGGFWSAWSEPVSLLTPSGEAPGGGVGGARANHGASPPPCPPPRLLDLDPLILTLSLILVVILVLLTVLALLSHRRALKQKIWPGIPSPESEFEGLFTTHKGNFQVGGLVVPSVPGLPCFSAAKLQASLSRLVLFLQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 757586 - protein, 276 aa, Homo sapiens
MYSSASIVITGTKCICASMTGSGGGIGEYSMSHIYVTIYIGFNRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 757587 - protein, 480 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYTMWLALRTPGCR

SEQ ID NO: 757588 - protein, 139 aa, Homo sapiens
MVLGEFWGLGSPSLFLLAQCRQDRQTRAHERDTQLAVSTRAPTPVNGGRSRPSAHPSLLVGCSDLELNSREPSATACSQPSPNQRSVSKEAVFCLFVCFLKTRSPSIPLAEVRWCKHNSPQPQPPGLKRSSSLSLPSSC

SEQ ID NO: 757589 - protein, 57 aa, Homo sapiens
MDEQTPPSNVAKGRERVDTSPRPPKGAQTCCSASWPLEGSVATSIVLPPRASGGERP

SEQ ID NO: 757590 - protein, 709 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757591 - protein, 233 aa, Homo sapiens
WRPWSRRRTPWAMSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757592 - protein, 875 aa, Homo sapiens
MWGGGEPWVWGRGVVGAVRGKPCTLSWIGSRAMCGLLADPGVPLLVAMAPAGAARAGVGLGVSGIPGPVLHPGLDLDPRALQRPSVGFQAEEILRHPGAAGSCYLAPSVSTARCCLSCLSVFLLNSDSQPAEHPHTHSGVGAQLPVYLVSLVQPGALPRPPQAGVDMAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757593 - protein, 709 aa, Homo sapiens; identical to SEQ ID NO: 757590

SEQ ID NO: 757594 - protein, 743 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEVRLPLVALAADGAEQALAGLGAGPAAWLPYVLLQAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757595 - protein, 624 aa, Homo sapiens [sequence omitted]

SEQ ID NO: 757596 - protein, 709 aa, Homo sapiens; identical to SEQ ID NO: 757590

SEQ ID NO: 757597 - protein, 709 aa, Homo sapiens; identical to SEQ ID NO: 757590

SEQ ID NO: 757598 - protein, 629 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMEIGIINGAGAQGRFFIQG

SEQ ID NO: 757599 - protein, 277 aa, Homo sapiens
MAEATTVNGRKQCWGLVVDTVLWSSSLAPFGWVSLDLSSSCPEAVGSCLPSSSLSLAVFSGRFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757600 - protein, 494 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEE

SEQ ID NO: 757601 - protein, 177 aa, Homo sapiens
NSRRQVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757602 - protein, 233 aa, Homo sapiens; identical to SEQ ID NO: 757591

SEQ ID NO: 757603 - protein, 406 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRYVQSQRNVLVLGEEEIRKW

SEQ ID NO: 757604 - protein, 219 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIL

SEQ ID NO: 757605 - protein, 80 aa, Homo sapiens
TTSLVTWCMSPHREEYGKLFDFVNAKKLNIKNRGLKEVLLCGEDETLSWSFYRGERGGDFFRLLFHSFFSSYPYRKKRCV

SEQ ID NO: 757606 - protein, 118 aa, Homo sapiens
APLSEQLSEVYLVEDMSTRVAAARYSPLPLLRLALTRLPAPSVRHSGAQCITCSYKASSGLLYPLERGFIYVHKPPVHIRFDEISFVNFARGTTTTRSFDFEIETKQGTQYTFSSIER

SEQ ID NO: 757607 - protein, 601 aa, Homo sapiens
VPPGSELRQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757608 - protein, 709 aa, Homo sapiens; identical to SEQ ID NO: 757590

SEQ ID NO: 757609 - protein, 709 aa, Homo sapiens; identical to SEQ ID NO: 757590

SEQ ID NO: 757610 - protein, 446 aa, Homo sapiens
MSRYQHANGLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757611 - protein, 301 aa, Homo sapiens
PTRPRPTRPRTRGSTHASDRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757612 - protein, 502 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEDLRHASLVR

SEQ ID NO: 757613 - protein, 238 aa, Homo sapiens
GCVLDFLDQLHFVHWLRLGQADRVNMCPFFRYGVSSSTASWSAAACTAPDITPPIGTSPTSWIFNVFFRSSLRSEISKRVRLAMSWTSCCILWSERTGPLRTITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 757614 - protein, 213 aa, Homo sapiens
MAIVDQRRAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKR

SEQ ID NO: 757615 - protein, 221 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTTPHPYFGTSFSS

SEQ ID NO: 757616 - protein, 73 aa, Homo sapiens
WTRFLPLSRQETGVPLEGSSVVTSPCFLCREEVEKRFEGRLTKNMSGSLYEMVSRVMKALVNRKITVPGNFQG

SEQ ID NO: 757617 - protein, 208 aa, Homo sapiens
ERGRSRLPALRWARMSGFLEELLGEKLVTGGGEEVDVHSLGARGISLLGLYFGCSLSAPCAQLSASLAAFYGRLRGDAAAGPGPGAGAGAAAEPEPRRRLEIVFVSSDQDQRQWQDFVRDMPWLALPYKEKHRKLKLWNKYRISNIPSLIFLDATTGKVVCRNGLLVIRDDPEGKTSARAYGPLITQPSLLHALRLISVPPVERVLVK

SEQ ID NO: 757618 - protein, 449 aa, Homo sapiens
ERGRSRLPALRWARMSGFLEELLGEKLVTGGGEEVDVHSLGARGISLLGLYFGCSLSAPCAQLSASLAAFYGRLRGDAAAGPGPGAGAGAAAEPEPRRRLEIVFVSSDQDQRQWQDFVRDMPWLALPYKEKHRKLKLWNKYRISNIPSLIFLDATTGKVVCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 757619 - protein, 186 aa, Homo sapiens
MPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 757620 - protein, 449 aa, Homo sapiens; identical to SEQ ID NO: 757618

SEQ ID NO: 757621 - protein, 449 aa, Homo sapiens; identical to SEQ ID NO: 757618

SEQ ID NO: 757622 - protein, 122 aa, Homo sapiens
MTDSLRDYTNLPEAASSFLSDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 757623 - protein, 163 aa, Homo sapiens
HWEVGGRRSWLLILWLRETLAGASGPGLGEAQPPRRVCEEFNGKTVYLGEQSCSVRQVPPGEPGAGEHCELCCWDACAHTPMHAGSKTCIQGELHFRSGAAQAGVSAAQAPSAGAALFDKPVLFLPVFFSPDPITDSEDDGESEAAKQLIQPIAEKIIAKYKA

SEQ ID NO: 757624 - protein, 343 aa, Homo sapiens
HRNRATVTVPLHRNRAMADVSLHRNPATLKLWNKYRISNIPSLIFLDATTGKVVCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 757625 - protein, 122 aa, Homo sapiens
MTQKVWSSPGDRNPSGKSLQGPCLETMGSLWRAAAWRGLTWASISPHIGVRPAEASPGSWWNPTGRSRRQARTSRSSSLVQTGRRSPSNSTSVRCPGSPSPTRMRPGGRASTGCTESKVLRP

SEQ ID NO: 757626 - protein, 343 aa, Homo sapiens; identical to SEQ ID NO: 757624

SEQ ID NO: 757627 - protein, 322 aa, Homo sapiens
MQELRNSLKLWNKYRISNIPSLIFLDATTGKVVCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 757628 - protein, 449 aa, Homo sapiens; identical to SEQ ID NO: 757618

SEQ ID NO: 757629 - protein, 449 aa, Homo sapiens; identical to SEQ ID NO: 757618

SEQ ID NO: 757630 - protein, 900 aa, Homo sapiens
MGDSGSRRSTLVSRLPIFRRSINRRHDSLPSSPSSSNTVGVHSSSPSSTNSSSGSTGKRRSIFRTPSISFHHKKGSEPKQEPTNQNLSISNGAQPGHSNMQKLSLEEHIKTRGRHSVGFSSSRNKKITRSLTEDFEREKEHSTNKNVFINCLSSGKSEGDDSGFTEDQTRRSVKQSTRKLLPKSFSSHYKFSKPVLQSQSISLVQQSEFSLEVTQYQEREPVLVRASPSCSVDVTERAGSSLQSPLLSADLTTAQTPSEFLALTEDSVSEMDAFSKSGSMASHCDNFGHNDSTSQMSLNSAAVTKTTTELTGTVPCAIMSPGKYRLEGQCSTESNSLPETSAANQKEVLLQIAELPATSVSHSESNLPADSEREENIGLQNGETMLGTNSPRKLGFYEQHKAIAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLDVLNNLGSCELDEDDLMLDLEFLEEQSLHPSVCREDSYHSVVSCAAVVLTPMEPMIEMKKREEPEFPEPSKQNLSLKLTKDVDQEARCSHISRMPNSPSADWPLQGVEENGGIDSLPFRLMLQDCTAVKTLLLKMKRVLQESADMSPASSTTSLPVSPLTEEPVPFKDIMKDECSMLKLQLKEKDELISQLQEELGKVRHLQKAFASRVDKSTQTELLCYDGLNLKRLETVQGGREATYRNRIVSQNLSTRDRKAIHTPTEDRFRYSAADQTSPYKNKTCQLPSLCLSNFLKDKELAEVIKHSRGTYETLTSDVTQNLRATVGQSSLKPTAKTEGLSTFLEKPKDQVATARQHSTFTGRFGQPPRGPISLHMYSRKNVFLHHNLHSTELQTLGQQDG

SEQ ID NO: 757631 - protein, 248 aa, Homo sapiens
NFKDVDQEARCSHISRMPNSPSADWPLQGVEENGGIDSLPFRLMLQDCTAVKTLLLKMKKFFKRNLSLKLTKDVDQEARCSHISRMPNSPSADWPLQGVEENGGIDSLPFRLMLQDCTAVKTLLLKMKRVLQESADMSPASSTTSLPVSPLTEEPVPFKDIMKDECSMLKLQLKEKDELISQLQEELGKVRHLQKAFASRVDKSTQTELLCYDPLGILPALNGYPRPFLLARSVPAPPVNKTFLAPPR

SEQ ID NO: 757632 - protein, 607 aa, Homo sapiens
MGDSGSRRSTLVSRLPIFRRSINRRHDSLPSSPSSSNTVGVHSSSPSSTNSSSGSTGKRRSIFRTPSISFHHKKGSEPKQEPTNQNLSISNGAQPGHSNMQKLSLEEHIKTRGRHSVGFSSSRNKKITRSLTEDFEREKEHSTNKNVFINCLSSGKSEGDDSGFTEDQTRRSVKQSTRKLLPKSFSSHYKFSKPVLQSQSISLVQQSEFSLEVTQYQEREPVLVRASPSCSVDVTERAGSSLQSPLLSADLTTAQTPSEFLALTEDSVSEMDAFSKSGSMASHCDNFGHNDSTSQMSLNSAAVTKTTTELTGTVPCAIMSPGKYRLEGQCSTESNSLPETSAANQKEVLLQIAELPATSVSHSESNLPADSEREENIGLQNGETMLGTNSPRKLGFYEQHKAIAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLDVLNNLGSCELDEDDLMLDLEFLEEQSLHPSELPQEHTRKAKRIHRPLKELDHRHRLPEMAKNFCREDSYHSVVSCAAVVLTPMEPMIEMKKREEPEFPEPSKQ

SEQ ID NO: 757633 - protein, 779 aa, Homo sapiens
MGDSGSRRSTLVSRLPIFRRSINRRHDSLPSSPSSSNTVGVHSSSPSSTNSSSGSTGKRRSIFRTPSISFHHKKGSEPKQEPTNQNLSISNGAQPGHSNMQKLSLEEHIKTRGRHSVGFSSSRNKKITRSLTEDFEREKEHSTNKNVFINCLSSGKSEGDDSGFTEDQTRRSVKQSTRKLLPKSFSSHYKFSKPVLQSQSISLVQQSEFSLEVTQYQEREPVLVRASPSCSVDVTERAGSSLQSPLLSADLTTAQTPSEFLALTEDSVSEMDAFSKSGSMASHCDNFGHNDSTSQMSLNSAAVTKTTTELTGTVPCAIMSPGKYRLEGQCSTESNSLPETSAANQKEVLLQIAELPATSVSHSESNLPADSEREENIGLQNGETMLGTNSPRKLGFYEQHKAIAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLDVLNNLGSCELDEDDLMLDLEFLEEQSLHPSELPQEHTRKAKRIHRPLKELDHRHRLPEMAKNFCREDSYHSVVSCAAVVLTPMEPMIEMKKREEPEFPEPSKQNLSLKLTKDVDQEARCSHISRMPNSPSADWPLQGVEENGGIDSLPFRLMLQDCTAVKTLLLKMKRVLQESADMSPASSTTSLPVSPLTEEPVPFKDIMKDECSMLKLQLKEKDELISQLQEELLPKILCSMRGGFICLAVFLEDSTDVFSDMHAPIKGKSPAFTEGFCFKSR

SEQ ID NO: 757634 - protein, 185 aa, Homo sapiens
MGKRTESVEGLNLKRLETVQGGREATYRNRIVSQNLSTRDRKAIHTPTEDRFRYSAADQTSPYKNKTCQLPSLCLSNFLKDKELAEVIKHSRGTYETLTSDVTQNLRATVGQSSLKPTAKTEGLSTFLEKPKDQVATARQHSTFTGRFGQPPRGPISLHMYSRKNVFLHHNLHSTELQTLGQQDG

SEQ ID NO: 757635 - protein, 35 aa, Homo sapiens
MAPFMGLQDQSQLLKKSSSVLAPQVSHKRPGKSHG

SEQ ID NO: 757636 - protein, 861 aa, Homo sapiens
MEALGPGPPASLFQPPRRPGLGTVGKPIRLLANHFQVQIPKIDVYHYDVDIKPEKRPRRVNREVVDTMVRHFKMQIFGDRQPGYDGKRNMYTAHPLPIGRDRVDMEVTLPGEGKDQTFKVSVQWVSVVSLQLLLEALAGHLNEVPDDSVQALDVITRHLPSMRYTPVGRSFFSPPEGYYHPLGGGREVWFGFHQSVRPAMWNMMLNIDVSATAFYRAQPIIEFMCEVLDIQNINEQTKPLTDSQRVKFTKEIRGLKVEVTHCGQMKRKYRVCNVTRRPASHQTFPLQLENGQAMECTVAQYFKQKYSLQLKYPHLPCLQVGQEQKHTYLPLEVCNIVAGQRCIKKLTDNQTSTMIKATARSAPDRQEEISRLVKSNSMVGGPDPYLKEFGIVVHNEMTELTGRVLPAPMLQYGGRNKTVATPNQGVWDMRGKQFYAGIEIKVWAVACFAPQKQCREDLLKSFTDQLRKISKDAGMPIQGQPCFCKYAQGADSVEPMFKHLKMTYVGLQLIVVILPGKTPVYAEVKRVGDTLLGMATQCVQVKNVVKTSPQTLSNLCLKINAKLGGINNVLVPHQRPSVFQQPVIFLGADVTHPPAGDGKKPSIAAVVGSMDGHPSRYCATVRVQTSRQEISQELLYSQEVIQDLTNMVRELLIQFYKSTRFKPTRIIYYRGGVSEGQMKQVAWPELIAIRKACISLEEDYRPGITYIVVQKRHHTRLFCADKTERVGKSGNVPAGTTVDSTITHPSEFDFYLCSHAGIQGTSRPSHYQVLWDDNCFTADELQLLTYQLCHTYVRCTRSVSIPAPAYYARLVAFRARYHLVDKDHDSAEGSHVSGQSNGRDPQALAKAVQIHHDTQHTMYFA

SEQ ID NO: 757637 - protein, 861 aa, Homo sapiens; identical to SEQ ID NO: 757636

SEQ ID NO: 757638 - protein, 986 aa, Homo sapiens
MEALGPGPPASLFQPPRRPGLGTVGKPIRLLANHFQVQIPKIDVYHYDVDIKPEKRPRRVNREVVDTMVRHFKMQIFGDRQPGYDGKRNMYTAHPLPIGRDRVDMEVTLPGEGKDQTFKVSVQWVSVVSLQLLLEALAGHLNEVPDDSVQALDVITRHLPSMRYTPVGRSFFSPPEGYYHPLGGGREVWFGFHQSVRPAMWNMMLNIDVSATAFYRAQPIIEFMCEVLDIQNINEQTKPLTDSQRVKFTKEIRGLKVEVTHCGQMKRKYRVCNVTRRPASHQTFPLQLENGQAMECTVAQYFKQKYSLQLKYPHLPCLQVGQEQKHTYLPLEVCNIVAGQRCIKKLTDNQTSTMIKATARSAPDRQEEISRLVSKAWSSRCASFEMTKNKRIENSSWDTVTLWFLYMQAFLFFEVKSNSMVGGPDPYLKEFGIVVHNEMTELTGRVLPAPMLQYGGRVSFLFYSASFFHNSQKENNPGFLYSATAEFTHSFVHYCLLCSGSYLIEFVYSLVNSKMALDCNVFSLFFCFFFFFFFFFFFSKNKTVATPNQGVWDMRGKQFYAGIEIKVWAVACFAPQKQCREDLLKSFTDQLRKISKDAGMPIQGQPCFCKYAQGADSVEPMFKHLKMTYVGLQLIVVILPGKTPVYAEVKRVGDTLLGMATQCVQVKNVVKTSPQTLSNLCLKINAKLGGINNVLVPHQRPSVFQQPVIFLGADVTHPPAGDGKKPSIAAVVGSMDGHPSRYCATVRVQTSRQEISQELLYSQEVIQDLTNMVRELLIQFYKSTRFKPTRIIYYRGGVSEGQMKQVAWPELIAIRKACISLEEDYRPGITYIVVQKRHHTRLFCADKTERVGKSGNVPAGTTVDSTITHPSEFDFYLCSHAGIQGTSRPSHYQVLWDDNCFTADELQLLTYQLCHTYVRCTRSVSIPAPAYYARLVAFRARYHLVDKDHDSAEGSHVSGQSNGRDPQALAKAVQIHHDTQHTMYFA

SEQ ID NO: 757639 - protein, 851 aa, Homo sapiens
MEALGPGPPASLFQPPRRPGLGTVGKPIRLLANHFQVQIPKIDVYHYDVDIKPEKRPRRVNREVVDTMVRHFKMQIFGDRQPGYDGKRNMYTAHPLPIGRDRVDMEVTLPGEGKDQTFKVSVQWVSVVSLQLLLEALAGHLNEVPDDSVQALDVITRHLPSMRYTPVGRSFFSPPEGYYHPLGGGREVWFGFHQSVRPAMWNMMLNIDVSATAFYRAQPIIEFMCEVLDIQNINEQTKPLTDSQRVKFTKEIRGLKVEVTHCGQMKRKYRVCNVTRRPASHQTFPLQLENGQAMECTVAQYFKQKYSLQLKYPHLPCLQVGQEQKHTYLPLEVCNIVAGQRCIKKLTDNQTSTMIKATARSAPDRQEEISRLVSKAWSSRCASFEMTKNKRIENSSWDTVTLWFLYMQAFLFFEVKSNSMVGGPDPYLKEFGIVVHNEMTELTGRVLPAPMLQYGGRVSFLFYSASFFHNSQKENNPGFLYSATAEFTHSFVHYCLLCSGSYLIEFVYSLVNSKMALDCNVFSLFFCFFFFFFFFFFFSKNKTVATPNQGVWDMRGKQFYAGIEIKVWAVACFAPQKQCREDLLKSFTDQLRKISKDAGMPIQGQPCFCKYAQGADSVEPMFKHLKMTYVGLQLIVVILPGKTPVYAEVKRVGDTLLGMATQCVQVKNVVKTSPQTLSNLCLKINAKLGGINNVLVPHQRPSVFQQPVIFLGADVTHPPAGDGKKPSIAAVVGSMDGHPSRYCATVRVQTSRQEISQELLYSQEVIQDLTNMVRELLIQFYKSTRFKPTRIIYYRGGVSEGQMKQVAWPELIAIRKACISLEEDYRPGITYIVVQKRHHTRLFCADKTERI

SEQ ID NO: 757640 - protein, 398 aa, Homo sapiens
MVLSTVVPAGTCHFSLPFLFYLHRRVVCDVFFAPQYKLFLAGNLHPKLIHASRIDISSGQDTSDICPLLGMATQCVQVKNVVKTSPQTLSNLCLKINAKLGGINNVLVPHQRPSVFQQPVIFLGADVTHPPAGDGKKPSIAAVVGSMDGHPSRYCATVRVQTSRQEISQELLYSQEVIQDLTNMVRELLIQFYKSTRFKPTRIIYYRGGVSEGQMKQVAWPELIAIRKACISLEEDYRPGITYIVVQKRHHTRLFCADKTERVGKSGNVPAGTTVDSTITHPSEFDFYLCSHAGIQGTSRPSHYQVLWDDNCFTADELQLLTYQLCHTYVRCTRSVSIPAPAYYARLVAFRARYHLVDKDHDSAEGSHVSGQSNGRDPQALAKAVQIHHDTQHTMYFA

SEQ ID NO: 757641 - protein, 986 aa, Homo sapiens; identical to SEQ ID NO: 757638

SEQ ID NO: 757642 - protein, 986 aa, Homo sapiens; identical to SEQ ID NO: 757638

SEQ ID NO: 757643 - protein, 986 aa, Homo sapiens; identical to SEQ ID NO: 757638

SEQ ID NO: 757644 - protein, 986 aa, Homo sapiens; identical to SEQ ID NO: 757638

SEQ ID NO: 757645 - protein, 986 aa, Homo sapiens; identical to SEQ ID NO: 757638

SEQ ID NO: 757646 - protein, 986 aa, Homo sapiens; identical to SEQ ID NO: 757638

SEQ ID NO: 757647 - protein, 81 aa, Homo sapiens
KLNKQDEFGALESVKAASELFSPLSGEVPEINEALAENPGLVNKSCYEDGWLIKMTLSNPSELDELMSEEAYEKYIKSIEE

SEQ ID NO: 757648 - protein, 81 aa, Homo sapiens; identical to SEQ ID NO: 757647

SEQ ID NO: 757649 - protein, 491 aa, Homo sapiens
CEGKAGGICSATGYWKAAFCLTDVHKMPYFTRLILFLFCLMVLVESRKPKRKRWTGQVEMPKPSHLYKKNLDVTKIRKGKPQQLLRVDEHDFSMRPAFGGPAIPVGVDVQVESLDSISEVDMDFTMTLYLRHYWKDERLAFSSASNKSMTFDGRLVKKIWVPDVFFVHSKRSFTHDTTTDNIMLRVFPDGHVLYSMRITVTAMCNMDFSHFPLDSQTCSLELESYAYTDEDLMLHWKNGDESLKTDEKISLSQFLIQKFHTTSRLAFYSSTGWYNRLYINFTLRRHIFFFLLQTYFPATLMVMLSWVSFWIDRRAVPARVSLGITTVLTMTTIITGVNASMPRVSYVKAVDIYLWVSFVFVFLSVLEYAAVNYLTTVQERKERKLREKFPCMCGMLHSKTMMLDGSYSESEANSLAGYPRSHILTEEERQDKIVVHLGLSGEANAARKKGLLKGQTGFRIFQNTHAIDKYSRLIFPASYIFFNLIYWSVFS

SEQ ID NO: 757650 - protein, 106 aa, Homo sapiens
MAHVCTSREEDRRPSSHVSPGRSHGPCLHIQGGGQKAQLTCESWQKPWPMSAHPGRRTEGPAQWPPPPTPHARTAGAEQPSFEVCPSPHLSLVLGPSPTPGLGSLS

SEQ ID NO: 757651 - protein, 635 aa, Homo sapiens
MTTWSLRRRPARTLGLLLLVVLGFLVLRRLDWSTLVPLRLRHRQLGLQAKGWNFMLEDSTFWIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGIPLPPPPDLLPKMPYEPLTPVLYLSLWDALKYLGEPIKSEKPINMENLPVNGGNGQSFGYILYETSITSSGILSGHVHDRGQVFVNTVSIGFLDYKTTKIAVPLIQGYTVLRILVENRGRVNYGENIDDQRKGLIGNLYLNDSPLKNFRIYSLDMKKSFFQRFGLDKWSSLPETPTLPAFFLGSLSISSTPCDTFLKLEGWEKGVVFINGQNLGRYWNIGPQKTLYLPGPWLSSGINQVIVFEETMAGPALQFHGNPPPGQEPVH

SEQ ID NO: 757652 - protein, 141 aa, Homo sapiens
MTTWSLRRRPARTLGLLLLVVLGFLVLRRLDWSTLVPLRLRHRQLGLQAKGWNFMLEDSTFWIFGGSIHYFRVPREYWRDRLLKMKACGLNTLTTYVPWNLHEPGPWLSSGINQVIVFEETMAGPALQFHGNPPPGQEPVH

SEQ ID NO: 757653 - protein, 584 aa, Homo sapiens
MTTWSLRRRPARTLGLLLLVVLGFLVLRRLDWSTLVPLRLRHRQLGLQAKGWNFMLEDSTFWIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGIPLPPPPDLLPKMPYEPLTPVLYLSLWDALKYLGEPIKSEKPINMENLPVNGGNGQSFGYILYETSITSSGILSGHVHDRGQVFVNTVSIGFLDYKTTKIAVPLIQGYTVLRILVENRGRVNYGENIDDQRKGLIGNLYLNDSPLKNFRIYSLDMKKSFFQRFGLDKWSSLPETPTLPAFFLGSLSISSTPLCPSPHLSLVLGPSPTPGLGSLS

SEQ ID NO: 757654 - protein, 410 aa, Homo sapiens
MTTWSLRRRPARTLGLLLLVVLGFLVLRRLDWSTLVPLRLRHRQLGLQAKGWNFMLEDSTFWIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGTQQTADSSSNSGPRFCSQTPKELLPYCPTSTPVDLRARIS

SEQ ID NO: 757655 - protein, 635 aa, Homo sapiens; identical to SEQ ID NO: 757651

SEQ ID NO: 757656 - protein, 635 aa, Homo sapiens; identical to SEQ ID NO: 757651

SEQ ID NO: 757657 - protein, 635 aa, Homo sapiens; identical to SEQ ID NO: 757651

SEQ ID NO: 757658 - protein, 113 aa, Homo sapiens
MAQKCLASPMAEMKTCGPSKLLPVLLCYMCCAGDRNDHDRARCLADYDAVLTEAGDYTAKYMKLRDFFGSISGTQQTADSSSNSGPRFCSQTPKELLPYCPTSTPVDLRARIS

SEQ ID NO: 757659 - protein, 397 aa, Homo sapiens
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLGPNHESPGRNPGYFLPLPGAYGGEAGCPAFPPEKKHALLSAQGQPRMPALLSFRHENHTESSVGVWCAA

SEQ ID NO: 757660 - protein, 375 aa, Homo sapiens
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPDHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLGPNHESPGRNPGYFLPLPGAYGGEAGCPAFPPEKKHALLSAQGQPRMPALLSFRHENHTESSVGVWCAA

SEQ ID NO: 757661 - protein, 301 aa, Homo sapiens
EELGDQAEGALLPFWEECEWLPFAARSIVLSNCKLIRLVVIIDFALSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLGPNHESPGRNPGYFLPLPGAYGGEAGCPAFPPEKKHALLSAQGQPRMPALLSFRHENHTESSVGVWCAA

SEQ ID NO: 757662 - protein, 313 aa, Homo sapiens
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSFRHENHTESSVGVWCAA

SEQ ID NO: 757663 - protein, 249 aa, Homo sapiens
MTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLGPNHESPGRNPGYFLPLPGAYGGEAGCPAFPPEKKHALLSAQGQPRMPALLSFRHENHTESSVGVWCAA

SEQ ID NO: 757664 - protein, 249 aa, Homo sapiens; identical to SEQ ID NO: 757663

SEQ ID NO: 757665 - protein, 209 aa, Homo sapiens
MSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDATEESWAEGGFCMLVKKNNLCQRKVLQQLCCKTCTFQG

SEQ ID NO: 757666 - protein, 882 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDVSLFRGA

SEQ ID NO: 757667 - protein, 913 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDATEESWAEGGFCMLVKKNNLCQRKVLQQLCCKTCTFQG

SEQ ID NO: 757668 - protein, 157 aa, Homo sapiens
AAATERKAKVLWRMWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 757669 - protein, 270 aa, Homo sapiens
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGAEGPDKPSVVSGLNSGPGHVWGPLLGLLLLPPLVLAGIF

SEQ ID NO: 757670 - protein, 133 aa, Homo sapiens
MCPLSGCPVAISFSPDRGSQASQEPPGPSQSPGLFLEPSESRTVPQKCLLPSQGEEVSCPPVIFPTLSPAPKQDTSWLRPSGRERLRGMCLITPSILEAQGLAGCELRRPPEDCTPGPHLSCPSLLSPGGGRI

SEQ ID NO: 757671 - protein, 369 aa, Homo sapiens
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGTPSSLATGIPAFLVTEVSGSLATKALPAVETQAPTSLATKDPPSMATEAPPCVTTEVPSILAAHSLPSLDEEPVTFPKSTHVPIPKSADKVTDKTKVPSRSPENSLDPKMSLTGARELLPHAQEEAEAEAELPPSSEV

SEQ ID NO: 757672 - protein, 270 aa, Homo sapiens; identical to SEQ ID NO: 757669

SEQ ID NO: 757673 - protein, 270 aa, Homo sapiens; identical to SEQ ID NO: 757669

SEQ ID NO: 757674 - protein, 428 aa, Homo sapiens
MTVGEYRHLANSKKYQTPPHQNFEDLERKYWKNRIYNSPIYGADISGSLFDENTKQWNLGHLGTIQDLLEKECGVVIEGVNTPYLYFGMWKTTFAWHTEDMDLYSINYLHLGEPKTWYVVPPEHGQRLERLARELFPGSSRGCGAFLRHKVALISPTVLKENGIPFNRITQEAGEFMVTFPYGYHAGFNHGFNCAEAINFATPRWIDYGKMASQCSCGEARVTFSMDAFVRILQPERYDLWKRGQDRAVVDHMEPRVPASQELSTQKEVQLPRRAALGLRQLPSHWARHSPWPMAARSGTRCHTLVCSSLPRRSAVSGTATQPRAAAVHSSKKPSSTPSSTPGPSAQIIHPSNGRRGRGRPPQKLRAQELTLQTPAKRPLLAGTTCTASGPEPEPLPEDGALMDKPVPLSPGLQHPVKASGCSWAPVP

SEQ ID NO: 757675 - protein, 2142 aa, Homo sapiens
MSDRSGPTAKGKDGKKYSSLNLFDTYKGKSLEIQKPACCPSPWPAESRESCHCPAYRPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLEFYPPGVHPSGLVPRERSDSLGLSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKLPASRSGAGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGGQANSAVTESFEEMMGVEVGQGDQTTLLLPEAAMPARHGARVQSMRKSPSGAGSGAQKQAARPMRVIWLLQTRRLPHPRREHSPRSSRSPTTRSPTLHRAPARFTCPGVGESSLPEGAISPGPRRREAPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGSHGLSITSKQWRLRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 757676 - protein, 663 aa, Homo sapiens
PRDRPRVRERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDFSPKPWERTGPPPREGPSRRAEEPGSRGDKEPGLPPPR

SEQ ID NO: 757677 - protein, 1877 aa, Homo sapiens
MSDRSGPTAKGKDGKKYSSLNLFDTYKGKSLEIQKPACCPSPWPAESRESCHCPAYRPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLEFYPPGVHPSGLVPRERSDSLGLSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKLPASRSGAGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGGQANSAVTESFEEMMGVEVGQGDQTTLLLPEAAMPARHGARVQSMRKSPSGAGSGAQKQAARPMRVIWLLQTRRLPHPRREHSPRSSRSPTTRSPTLHRAPARFTCPGVGESSLPEGAISPGPRRREAPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDFSPKPWERTGPPPREGPSRRAEEPGSRGDKEPGLPPPR

SEQ ID NO: 757678 - protein, 3176 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 757679 - protein, 2951 aa, Homo sapiens
MSFFKDVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 757680 - protein, 2769 aa, Homo sapiens
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 757681 - protein, 1094 aa, Homo sapiens
AARYPSCLLPRSPSLGYPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 757682 - protein, 2176 aa, Homo sapiens
MSFFKDVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGNGRKRNLRFMEAEARENFGAWMWRSPTAELTQEIVFQKKAERRLGLRIRLGYGGGTCMFKGKEN

SEQ ID NO: 757683 - protein, 914 aa, Homo sapiens
IVDPRVRGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 757684 - protein, 1418 aa, Homo sapiens
MSFFKDVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 757685 - protein, 628 aa, Homo sapiens
MSFFKDVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRNYLSFGLEKVILMER

SEQ ID NO: 757686 - protein, 3151 aa, Homo sapiens
MSFFKDVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 757687 - protein, 2338 aa, Homo sapiens
SILKSLYPNLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 757688 - protein, 2192 aa, Homo sapiens
MSFFKDVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMVRCCTFLDSPCTEGKRKDTLLGSSAATEAKDVAFNTAT

SEQ ID NO: 757689 - protein, 2079 aa, Homo sapiens
MSFFKDVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKLSRVPQTQRN

SEQ ID NO: 757690 - protein, 844 aa, Homo sapiens
AGNPLANGIRGVWGDRLQDEWTEGRPWYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKTATVRPPVAVKPATAAKPVAAKPAAVRPPAAAAKPVATKPEVPRPQAAKPAATKPATTKPVVKMLREVQVFEITENSAKLHWERPEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 757691 - protein, 1419 aa, Homo sapiens
MSFFKDVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKAEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAQTSSALGASS

SEQ ID NO: 757692 - protein, 384 aa, Homo sapiens
MAIAYLGSSCPSQPPSSLALSLSPTPSDFEQESGIETAMRFSPDVALAVSTTPAVLPTTNIQPVGTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 757693 - protein, 370 aa, Homo sapiens
MAIAYLGSSCPSQPPSSLALSLSPTPSDFEQESGIETAMRFSPDVALAVSTTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 757694 - protein, 135 aa, Homo sapiens
VLQRIRKDLWAATRWRNPSRRASHTRSLTSRRSSMPSGATVPPCSLNTTLLSSPQPGPTSPSLGLGLEPGPSSSLPSLPRSAQAASLTQIFPEEEGLLPSAPDCALTSSSLVPLIPATSLGLQDLMSDGWEEESS

SEQ ID NO: 757695 - protein, 442 aa, Homo sapiens
MKPGPPHRAGAAHGAGAGAGAAAGPGARGLLLPPLLLLLLAGRAAGAQRWRSENFERPVDLEGSGDDDSFPDDELDDLYSGSGSGYFEQESGIETAMRFSPDVALAVSTTPAVLPTTNIQPVGTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 757696 - protein, 442 aa, Homo sapiens; identical to SEQ ID NO: 757695

SEQ ID NO: 757697 - protein, 370 aa, Homo sapiens; identical to SEQ ID NO: 757693

SEQ ID NO: 757698 - protein, 442 aa, Homo sapiens; identical to SEQ ID NO: 757695

SEQ ID NO: 757699 - protein, 442 aa, Homo sapiens; identical to SEQ ID NO: 757695

SEQ ID NO: 757700 - protein, 280 aa, Homo sapiens
MATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 757701 - protein, 116 aa, Homo sapiens [sequence omitted]

SEQ ID NO: 757702 - protein, 442 aa, Homo sapiens; identical to SEQ ID NO: 757695

SEQ ID NO: 757703 - protein, 126 aa, Homo sapiens [sequence omitted]

SEQ ID NO: 757704 - protein, 111 aa, Homo sapiens
MSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEVMLNCIRVRKKKRR

SEQ ID NO: 757705 - protein, 855 aa, Homo sapiens
MSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESVIEPQALNDVDGEEEGTVNSQSGESENENELDNSLNSQSNTNTDRFLQQLTEENFELISKLWTDIQQKIATQSQITPPGTPSSALSSGEQRAALNATNAVKRLQTRLQPEESTETLDSSYVVGHVLNSRKQKQLLNKVKRKPNLHALSKPKKNISSGSTTSADLPNRTNSNLDVLKHMIHEVEHEMEEYERWTGREVKGLQSSQGLTGFTLSLVSSLCRLVRYLKESEIQLRKEVETRQQLEQVLGDHRELIDALTAEILRLREENAATQARLQQYMVTTDEQLISLTHAIKNCPVINNRQEIQASESGATGRRVMDSPERPVVNANVSVPLMFREEVAEFPQEELPVKLSQVPDPPDNMNLAKNFPAHIFEPAVLLTPPRQKSNLKFSPLQDVLRRTVQTRPAPRLPPTVEIIEKEQNWEEKTLPIDTDIQNSSEENRLFTQRWRVSHMGEDLENKTQAPFVNLSQPLCNSHSNTQQSRSPTFSEELPVLGDGQQLRTNESLIQRKDIMTRIADLTLQNSAIKAHMNNIIEPRGEQGDGLRELNKQESASDMTSTFPVAQSLTPGSMEERIAELNRQSMEARGKLLQLIEQQKLVGLNLSPPMSPVQLPLRAWTEGAKRTIEVSIPGAEAPESSKCSTVSPVSGINTRRSSGATGNSCSPLNATSGSGRFTPLNPRAKIEKQNEEGWFALSTHVS

SEQ ID NO: 757706 - protein, 869 aa, Homo sapiens
MRVRTAFGSFCTELMSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESVIEPQALNDVDGEEEGTVNSQSGESENENELDNSLNSQSNTNTDRFLQQLTEENFELISKLWTDIQQKIATQSQITPPGTPSSALSSGEQRAALNATNAVKRLQTRLQPEESTETLDSSYVVGHVLNSRKQKQLLNKVKRKPNLHALSKPKKNISSGSTTSADLPNRTNSNLDVLKHMIHEVEHEMEEYERWTGREVKGLQSSQGLTGFTLSLVSSLCRLVRYLKESEIQLRKEVETRQQLEQVLGDHRELIDALTAEILRLREENAATQARLQQYMVTTDEQLISLTHAIKNCPVINNRQEIQASESGATGRRVMDSPERPVVNANVSVPLMFREEVAEFPQEELPVKLSQVPDPPDNMNLAKNFPAHIFEPAVLLTPPRQKSNLKFSPLQDVLRRTVQTRPAPRLPPTVEIIEKEQNWEEKTLPIDTDIQNSSEENRLFTQRWRVSHMGEDLENKTQAPFVNLSQPLCNSHSNTQQSRSPTFSEELPVLGDGQQLRTNESLIQRKDIMTRIADLTLQNSAIKAHMNNIIEPRGEQGDGLRELNKQESASDMTSTFPVAQSLTPGSMEERIAELNRQSMEARGKLLQLIEQQKLVGLNLSPPMSPVQLPLRAWTEGAKRTIEVSIPGAEAPESSKCSTVSPVSGINTRRSSGATGNSCSPLNATSGSGRFTPLNPRAKIEKQNEEGWFALSTHVS

SEQ ID NO: 757707 - protein, 855 aa, Homo sapiens; identical to SEQ ID NO: 757705

SEQ ID NO: 757708 - protein, 896 aa, Homo sapiens
DCSVGGVHRVAGERQTIQGALGPGASFKSMDVRGASQKAPPMSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESVIEPQALNDVDGEEEGTVNSQSGESENENELDNSLNSQSNTNTDRFLQQLTEENFELISKLWTDIQQKIATQSQITPPGTPSSALSSGEQRAALNATNAVKRLQTRLQPEESTETLDSSYVVGHVLNSRKQKQLLNKVKRKPNLHALSKPKKNISSGSTTSADLPNRTNSNLDVLKHMIHEVEHEMEEYERWTGREVKGLQSSQGLTGFTLSLVSSLCRLVRYLKESEIQLRKEVETRQQLEQVLGDHRELIDALTAEILRLREENAATQARLQQYMVTTDEQLISLTHAIKNCPVINNRQEIQASESGATGRRVMDSPERPVVNANVSVPLMFREEVAEFPQEELPVKLSQVPDPPDNMNLAKNFPAHIFEPAVLLTPPRQKSNLKFSPLQDVLRRTVQTRPAPRLPPTVEIIEKEQNWEEKTLPIDTDIQNSSEENRLFTQRWRVSHMGEDLENKTQAPFVNLSQPLCNSHSNTQQSRSPTFSEELPVLGDGQQLRTNESLIQRKDIMTRIADLTLQNSAIKAHMNNIIEPRGEQGDGLRELNKQESASDMTSTFPVAQSLTPGSMEERIAELNRQSMEARGKLLQLIEQQKLVGLNLSPPMSPVQLPLRAWTEGAKRTIEVSIPGAEAPESSKCSTVSPVSGINTRRSSGATGNSCSPLNATSGSGRFTPLNPRAKIEKQNEEGWFALSTHVS

SEQ ID NO: 757709 - protein, 364 aa, Homo sapiens [sequence omitted]

SEQ ID NO: 757710 - protein, 377 aa, Homo sapiens
MSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESVIEPQALNDVDGEEEGTVNSQSGESENENELDNSLNSQSNTNTDRFLQQLTEENFELISKLWTDIQQKIATQSQITPPGTPSSALSSGEQRAALNATNAVKRLQTRLQPEESTETLDSSYVVGHVLNSRKQKQLLNKEGAKRTIEVSIPGAEAPESSKCSTVSPVSGINTRRSSGATGNSCSPLNATSGSGRFTPLNPRAKIEKQNEEGWFALSTHVS

SEQ ID NO: 757711 - protein, 80 aa, Homo sapiens
MSRPGLGYGPQAWSSMLGRGLLTDELPPGIGVGVGAVVSGSERLCTGRSRTGSSSSSASADRAAMAKRSGSSRSSAAAAA

SEQ ID NO: 757712 - protein, 188 aa, Homo sapiens
GQTSERCIWDQILTVRPRHKGSNHPFPSELPYRDPCSNGGKGRNAAAQQMDKKRTGLVSGTFSEENVIREFNLNELYQRARNYQRLETISLRSSLWLQPPPQCQMGKTRRINKILTLAVLPLLSIPGSFHNHKPEAAAFYLCFPFGCDWVGQHAASDFKEASRELSGTLQEGLPCCGQLFHWSKKEIS

SEQ ID NO: 757713 - protein, 117 aa, Homo sapiens
SGQTVPVPGRGGEFSLRPRTLDGGVARRRASPAWVGLPFALEAGLSAGGPLANPEVDTREMGGIGKGTQPFRPFPQSRPASLPCGCRRLQCHSPGFRLGRRRDCRPDPNAEALRLLM

SEQ ID NO: 757714 - protein, 467 aa, Homo sapiens [sequence omitted]

SEQ ID NO: 757715 - protein, 444 aa, Homo sapiens
MQQIPQEKSINDYLEKFYQLPSNQYQSTRKNGTNVIVEKLKEMQRFFGLNVTGKPNEETLDMMKKPRCGVPDSGGFMLTPGNPKWERTNLTYRIRNYTPQLSEAEVERAIKDAFELWSVASPLIFTRISQGEADINIAFYQRDHGDNSPFDGPNGILAHAFQPGQGIGGDAHFDAEETWTNTSANYNLFLVAAHEFGHSLGLAHSSDPGALMYPNYAFRETSNYSLPQDDIDGIQAIYGLSSNPIQPTGPSTPKPCDPSLTFDAITTLRGEILFFKDRYFWRRHPQLQRVEMNFISLFWPSLPTGIQAAYEDFDRDLIFLFKGNQYWALSGYDILQGYPKDISNYGFPSSVQAIDAAVFYRSKTYFFVNDQFWRYDNQRQFMEPGYPKSISGAFPGIESKVDAVFQQEHFFHVFSGPRYYAFDLIAQRVTRVARGNKWLNCRYG

SEQ ID NO: 757716 - protein, 444 aa, Homo sapiens; identical to SEQ ID NO: 757715

SEQ ID NO: 757717 - protein, 135 aa, Homo sapiens [sequence omitted]

SEQ ID NO: 757718 - protein, 84 aa, Homo sapiens
MPVSKCPKKSESLWKGWDRKAQRNGLRSQVYAVNGDYYVGEWKDNVKHGKGTQVWKKKGAIYGGGLEVWGSETATAPSAFLDQQ

SEQ ID NO: 757719 - protein, 86 aa, Homo sapiens
MPVSKCPKKSESLWKGWDRKAQRNGLRSQVYAVNGDYYVGEWKDNVKHGSSVFQTTSITALQKTVQYGFCWVVWTPNPQLIQSPKQ

SEQ ID NO: 757720 - protein, 2468 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 757721 - protein, 2468 aa, Homo sapiens; identical to SEQ ID NO: 757720

SEQ ID NO: 757722 - protein, 2342 aa, Homo sapiens
MITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 757723 - protein, 2475 aa, Homo sapiens
RIELGTSRGGVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 757724 - protein, 2376 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 757725 - protein, 2127 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPFSKKSIHLVKSLNNYLPNAILCHGDASH

SEQ ID NO: 757726 - protein, 2468 aa, Homo sapiens; identical to SEQ ID NO: 757720

SEQ ID NO: 757727 - protein, 2468 aa, Homo sapiens; identical to SEQ ID NO: 757720

SEQ ID NO: 757728 - protein, 1870 aa, Homo sapiens
MGRNPYVCAPPSTAPLKDEESAKAEADAYIREKRESVASGDDRAEEDMDEAIEKGEAQSKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 757729 - protein, 1232 aa, Homo sapiens
VTQETPDYFCLCRDFNLIGLSERSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 757730 - protein, 2258 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKTPIKKEEKPKKEEVKKEVKKEIKKEEKKEPKKEVKKETPPKEVKKEVKKEEKKEVKKEEKEP

SEQ ID NO: 757731 - protein, 1188 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTHPYWPGY

SEQ ID NO: 757732 - protein, 752 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKTKKKKKKKKKKKKNKKKKNKKKK

SEQ ID NO: 757733 - protein, 459 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQTNMAHAYLRIKPARCAHVP

SEQ ID NO: 757734 - protein, 181 aa, Homo sapiens
RIELGTSRGGVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGEY

SEQ ID NO: 757735 - protein, 2468 aa, Homo sapiens; identical to SEQ ID NO: 757720

SEQ ID NO: 757736 - protein, 2468 aa, Homo sapiens; identical to SEQ ID NO: 757720

SEQ ID NO: 757737 - protein, 2387 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 757738 - protein, 2468 aa, Homo sapiens; identical to SEQ ID NO: 757720

SEQ ID NO: 757739 - protein, 1866 aa, Homo sapiens
PSLLAENLHLQFMMRLYLEAQRARPPLLMRRIEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 757740 - protein, 2468 aa, Homo sapiens; identical to SEQ ID NO: 757720

SEQ ID NO: 757741 - protein, 2340 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASARNSTSGISSGQD

SEQ ID NO: 757742 - protein, 955 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEVKKEEKEPKKEIKKLPKDAKKSSTPLSEAKKPAALKPKVPKKEESVKKETPPKEVKKEVKKEEKKEVKKEEKEP

SEQ ID NO: 757743 - protein, 567 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVGRSRIRLSTS

SEQ ID NO: 757744 - protein, 187 aa, Homo sapiens
RIELGTSRGGVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLTPRHP

SEQ ID NO: 757745 - protein, 113 aa, Homo sapiens
GRVEGPPLRPPATSRRWAGPTLWRMEVTGDAGVPESGEIRTLKPCLLRRNYSREQHGVAASCLEDLRSKACDILAIDKSLTPVTLVLAEDGTIVDDDDYFLCLPSNTKFVALA

SEQ ID NO: 757746 - protein, 292 aa, Homo sapiens
GRVEGPPLRPPATSRRWAGPTLWRMEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLEVGGNQGH

SEQ ID NO: 757747 - protein, 292 aa, Homo sapiens; identical to SEQ ID NO: 757746

SEQ ID NO: 757748 - protein, 292 aa, Homo sapiens; identical to SEQ ID NO: 757746

SEQ ID NO: 757749 - protein, 183 aa, Homo sapiens
GRVEGPPLRPPATSRRWAGPTLWRMEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQSPKLPLVRRWMQ

SEQ ID NO: 757750 - protein, 292 aa, Homo sapiens; identical to SEQ ID NO: 757746

SEQ ID NO: 757751 - protein, 292 aa, Homo sapiens; identical to SEQ ID NO: 757746

SEQ ID NO: 757752 - protein, 292 aa, Homo sapiens; identical to SEQ ID NO: 757746

SEQ ID NO: 757753 - protein, 292 aa, Homo sapiens; identical to SEQ ID NO: 757746

SEQ ID NO: 757754 - protein, 355 aa, Homo sapiens
GRVEGPPLRPPATSRRWAGPTLWRMEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLELVTKEDPKALAVALNWDIKKTETVQEACERELALRLQQTQSLHSLRSISASKASPPGDLQNPKRARQDPT

SEQ ID NO: 757755 - protein, 292 aa, Homo sapiens; identical to SEQ ID NO: 757746

SEQ ID NO: 757756 - protein, 183 aa, Homo sapiens; identical to SEQ ID NO: 757749

SEQ ID NO: 757757 - protein, 355 aa, Homo sapiens; identical to SEQ ID NO: 757754

SEQ ID NO: 757758 - protein, 99 aa, Homo sapiens
NYISRQAAEGGRVEGPPLRPPATSRRWAGPTLWRMEVTGDAGVPESGEIRTLKPCLLRRNYSREQHGVAASCLEDLRSKGWLGTPGEGVGEPGPGEDVR

SEQ ID NO: 757759 - protein, 412 aa, Homo sapiens
MVVSTWRDPQDEVPGSQGSQASQAPPVPGPPPGAPHTPQTPGQGGPASTPAQTAAGGQGGPGGPGSDKQQQQQHIECVVCGDKSSGKHYGQFTCEGCKSFFKRSVRRNLSYTCRANRNCPIDQHHRNQCQYCRLKKCLKVGMRREAVQRGRMPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 757760 - protein, 412 aa, Homo sapiens; identical to SEQ ID NO: 757759

SEQ ID NO: 757761 - protein, 281 aa, Homo sapiens
MQAVWDLEQGKYGFAVQRGRMPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 757762 - protein, 275 aa, Homo sapiens
GVSPFLPAAVQRGRMPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 757763 - protein, 412 aa, Homo sapiens; identical to SEQ ID NO: 757759

SEQ ID NO: 757764 - protein, 412 aa, Homo sapiens; identical to SEQ ID NO: 757759

SEQ ID NO: 757765 - protein, 412 aa, Homo sapiens; identical to SEQ ID NO: 757759

SEQ ID NO: 757766 - protein, 622 aa, Homo sapiens
MVVSTWRDPQDEVPGSQGSQASQAPPVPGPPPGAPHTPQTPGQGGPASTPAQTAAGGQGGPGGPGSDKQQQQQHIECVVCGDKSSGKHYGQFTCEGCKSFFKRSVRRNLSYTCRANRNCPIDQHHRNQCQYCRLKKCLKVGMRREAVQRGRMPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRCGLVILTFEISLLVNKIYTATLFLAPCLDFSHILHYIRFTGEDSDKTNDTIPKVTRVKYSSIMTIVSYPLYRTKFSWILCTTRGNISTNSTGKFPAKTLKILVKPYDSANVSSHDSTDHASDLGTTHCGTLSNKAISAHTGPTAQKMDKRKHTTQHHRGHPTRSESPPRPTRWCHAHALKHASRPPNLTTATKRTTQKQHAHRSSSATQPHNQNSRTTTTTDNQNTRDRASQRQQHTQA

SEQ ID NO: 757767 - protein, 111 aa, Homo sapiens
MSWRGRSTYRPRPRRSLQPPELIGAMLEPTDEEPKEEKPPTKSRNPTPDQKREDDQGAAEIQVPDLEADLQELCQTKTGDGCEGGTDVKGKILPKAEHFKMPEAGEGKSQV

SEQ ID NO: 757768 - protein, 111 aa, Homo sapiens; identical to SEQ ID NO: 757767

SEQ ID NO: 757769 - protein, 111 aa, Homo sapiens; identical to SEQ ID NO: 757767

SEQ ID NO: 757770 - protein, 524 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAVYGGYAGYIPQAFPAAAIQVPIPDVYQTY

SEQ ID NO: 757771 - protein, 524 aa, Homo sapiens; identical to SEQ ID NO: 757770

SEQ ID NO: 757772 - protein, 524 aa, Homo sapiens; identical to SEQ ID NO: 757770

SEQ ID NO: 757773 - protein, 524 aa, Homo sapiens; identical to SEQ ID NO: 757770

SEQ ID NO: 757774 - protein, 593 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAVYGGYAGYIPQAFPAAAIQVPIPDVYQTY

SEQ ID NO: 757775 - protein, 593 aa, Homo sapiens; identical to SEQ ID NO: 757774

SEQ ID NO: 757776 - protein, 524 aa, Homo sapiens; identical to SEQ ID NO: 757770

SEQ ID NO: 757777 - protein, 593 aa, Homo sapiens; identical to SEQ ID NO: 757774

SEQ ID NO: 757778 - protein, 593 aa, Homo sapiens; identical to SEQ ID NO: 757774

SEQ ID NO: 757779 - protein, 644 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAVYGGYAGYIPQAFPAAAIQVPIPDVYQTTQTPLKERLTIYEEGTCWIHTCNLKVKNVSRFISELFYIHEVFTSFLRLFST

SEQ ID NO: 757780 - protein, 531 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGQPLSFPLCRRHHLSRPPNNSSIHGGSKRSENSYCRDLRGQLRAICCSSYSHDRHTTEERGSRGRRVWRIRRLHTSGLPCCCHSGPHPRRLPDILRLVTSTKTDHTNTTEGTLDYL

SEQ ID NO: 757781 - protein, 369 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAICCSSYSHDRHTTEERGSRGRRVWRIRRLHTSGLPCCCHSGPHPRRLPDILRLVTSTKTDHTNTTEGTLDYL

SEQ ID NO: 757782 - protein, 158 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRQPLSFPLCRRHHLSRAAQ

SEQ ID NO: 757783 - protein, 119 aa, Homo sapiens
MIGTYTCSGRLLFVSSPQGPPNNSSIHGGSKRSENSYCRDLRGQLRAICCSSYSHDRHTTEERGSRGRRVWRIRRLHTSGLPCCCHSGPHPRRLPDILRLVTSTKTDHTNTTEGTLDYL

SEQ ID NO: 757784 - protein, 211 aa, Homo sapiens
AFSQGRLSQQDKISGQIYGKLPVLGVKIWFGEFKKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAVYGGYAGYIPQAFPAAAIQVPIPDVYQTY

SEQ ID NO: 757785 - protein, 139 aa, Homo sapiens [sequence omitted]

SEQ ID NO: 757786 - protein, 116 aa, Homo sapiens
MTAEDSTAAMSSDSAAGSSAKVPEGVAGAPNEAALLALMERTGYSMVQENVQRIPTAGIYGASYVPFAAPATATIATLQKNAAAAAAVYGGYAGYIPQAFPAAAIQVPIPDVYQTY

SEQ ID NO: 757787 - protein, 120 aa, Homo sapiens
MKGKDSRCHSHCVDATTFPGPPNNSSIHGGSKRSENSYCRDLRGQLRAICCSSYSHDRHTTEERGSRGRRVWRIRRLHTSGLPCCCHSGPHPRRLPDILRLVTSTKTDHTNTTEGTLDYL

SEQ ID NO: 757788 - protein, 126 aa, Homo sapiens
AEFGNPYLNPVAIKLGTVAILPGPRGSYLGGYSAGRGIYSRYHEGKGGRPITPVYTVAPNVQRIPTAGIYGASYVPFAAPATATIATLQKNAAAAAAVYGGYAGYIPQAFPAAAIQVPIPDVYQTY

SEQ ID NO: 757789 - protein, 593 aa, Homo sapiens; identical to SEQ ID NO: 757774

SEQ ID NO: 757790 - protein, 593 aa, Homo sapiens; identical to SEQ ID NO: 757774

SEQ ID NO: 757791 - protein, 593 aa, Homo sapiens; identical to SEQ ID NO: 757774

SEQ ID NO: 757792 - protein, 593 aa, Homo sapiens; identical to SEQ ID NO: 757774

SEQ ID NO: 757793 - protein, 593 aa, Homo sapiens; identical to SEQ ID NO: 757774

SEQ ID NO: 757794 - protein, 593 aa, Homo sapiens; identical to SEQ ID NO: 757774

SEQ ID NO: 757795 - protein, 582 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAVYGGYAGEFLEPRRRRLQ

SEQ ID NO: 757796 - protein, 376 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAA

SEQ ID NO: 757797 - protein, 34 aa, Homo sapiens
MVGTILGTEAMPSPPDEPPKLWASLSSFIKLEKL

SEQ ID NO: 757798 - protein, 213 aa, Homo sapiens
MPRLLRLSLLWLGLLLVRFSRELSDISSARKLCGRYLVKEIEKLCGHANWSQFRFEEETPFSRLIAQASEKVEAYSPYQFESPQTASPARGRGTNPVSTSWEEAVNSWEMQSLPEYKDKKGYSPLGKTREFSSSHNINVYIHENAKFQKKRRNKIKTLSNLFWGHHPQRKRRGYSEKCCLTGCTKEELSIACLPYIDFKRLKEKRSSLVTKIY

SEQ ID NO: 757799 - protein, 177 aa, Homo sapiens
MPRLLRLSLLWLGLLLVRFSRELSDISSARKLCGRYLVKEIEKLCGHANWSQFRFEEETPFSRLIAQASEKVEAYSPYQFESPQTASPARGRGTNPVSTSWEEAVNSWEMQSLPEYKDKKGYSPLGLLEFAGGPLQMLFAWVSPAEAAEQQRLLPVPSSGSFIPEGHPLDASQSFPV

SEQ ID NO: 757800 - protein, 505 aa, Homo sapiens
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 757801 - protein, 102 aa, Homo sapiens
EGEVVLTEPCSQPRSSSDSISGVHLLCLALFDACWEGQSIAKSDEHQARHAGTVLDPGLLPPGHATIYNCVNILQGWPERLGLMASEVHGVAKFSCHFLTLL

SEQ ID NO: 757802 - protein, 454 aa, Homo sapiens
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSSYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 757803 - protein, 434 aa, Homo sapiens
MNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 757804 - protein, 438 aa, Homo sapiens
GTDSITVLRSSSSGPTGTRNARFLFLGDRQCRREAVWEYSEEQGRSEFHLFLPFSRWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 757805 - protein, 131 aa, Homo sapiens [sequence omitted]

SEQ ID NO: 757806 - protein, 468 aa, Homo sapiens
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGPSSHQVGRPGSIHLGVFTIKRRVAVEAPEEVAYGGCLPGWDPRGSRWGGPLGPPARGLGFLGRPGPLFGGGTPE

SEQ ID NO: 757807 - protein, 398 aa, Homo sapiens
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGKHSP

SEQ ID NO: 757808 - protein, 117 aa, Homo sapiens
LLFWASRRGVYSAEEQHSHLSTPSKKQLLPQQPTGAVRGTQCGLGLGVEAPRLSFTMCLFPQIAEGMAYIERMNSIHRDLRAANILVSEALCCKIADFGLARIIDSEYTAQEGKHSP

SEQ ID NO: 757809 - protein, 125 aa, Homo sapiens
GCLETGQPGNARGWRSGLGLWALLSLAWAHCAPRDAQGPPPTEDPSPSPPLAVSSAAGMSNPEVIRNLERGYRMPRPDTCPPELYRGVIAECWRSRPEERPTFEFLQSVLEDFYTATERQYELQP

SEQ ID NO: 757810 - protein, 124 aa, Homo sapiens [sequence omitted]

SEQ ID NO: 757811 - protein, 819 aa, Homo sapiens
RALPEDAAAPAPAMGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 757812 - protein, 707 aa, Homo sapiens
RALPEDAAAPAPAMGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 757813 - protein, 819 aa, Homo sapiens; identical to SEQ ID NO: 757811

SEQ ID NO: 757814 - protein, 649 aa, Homo sapiens
GTDRIELRYERVMRMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 757815 - protein, 642 aa, Homo sapiens
GTDRIELRYERVMRMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 757816 - protein, 628 aa, Homo sapiens
GTDRIELRYERVMRMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 757817 - protein, 840 aa, Homo sapiens
GTDRIELRYERVMRMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLATGPQQCEGSLAAHPAAGAQPLPGMRLSADGETATQSFGLCVCVCVCVCVCTSACACVRAHLASRCRGTLGVPAAVQRSPDWCCSTEGPLFWGDPVQNVSGPTRWDPRGAGSWARHGSGLCLCTTGHHRVGLGPSQHPKLSLQGSPTCPAPCAWGVSGTASPPPGFPTSHPAPQRLKLRVPEDGSLYLLCKRFIPETSVHFYK

SEQ ID NO: 757818 - protein, 819 aa, Homo sapiens; identical to SEQ ID NO: 757811

SEQ ID NO: 757819 - protein, 403 aa, Homo sapiens
EQIESSSDERVMRMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLVQVPMLLDVTSLYISIYIIY

SEQ ID NO: 757820 - protein, 217 aa, Homo sapiens
GTDRIELRYERVMRMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAREGLLAERSRAPSR

SEQ ID NO: 757821 - protein, 587 aa, Homo sapiens
LYKRAVVTTEAPKMLLRALEKLQQNRASPLAGRAGALRPPPPPSSAKGAFAERLAASTGAPLQRADPPAQRRHVALGRVPCRERSSLLALNAWRGRYFRKLQEQAGEGKSYSSIFTCFNYYFLLGMDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPNSEVVYVWTNGSTKSVVVAEDGSRLNQYHLMGQTVGTENISTSTGEYTIMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKKALEAAKIKKKREVILNKSTNAFTTGKMSHPPNIPKEQTPAGTSNTTSVSVKPSEEKTSESKKTYNSISKIDKMSRIVFPVLFGTFNLVYWATYLNREPVIKGAASPK

SEQ ID NO: 757822 - protein, 352 aa, Homo sapiens
MWRSGECLPLNNLLASKIWTPDTFFHNGKKSIAHNMTTPNKLLRLEDDGTLLYTMRLTISAECPMQLEDFPMDAHACPLKFGSYAYPNSEVVYVWTNGSTKSVVVAEDGSRLNQYHLMGQTVGTENISTSTGEYTIMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKKALEAAKIKKKREVILNKSTNAFTTGKMSHPPNIPKEQTPAGTSNTTSVSVKPSEEKTSESKKTYNSISKIDKMSRIVFPVLFGTFNLVYWATYLNREPVIKGAASPK

SEQ ID NO: 757823 - protein, 501 aa, Homo sapiens
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 757824 - protein, 501 aa, Homo sapiens; identical to SEQ ID NO: 757823

SEQ ID NO: 757825 - protein, 501 aa, Homo sapiens; identical to SEQ ID NO: 757823

SEQ ID NO: 757826 - protein, 501 aa, Homo sapiens; identical to SEQ ID NO: 757823

SEQ ID NO: 757827 - protein, 501 aa, Homo sapiens; identical to SEQ ID NO: 757823

SEQ ID NO: 757828 - protein, 501 aa, Homo sapiens; identical to SEQ ID NO: 757823

SEQ ID NO: 757829 - protein, 439 aa, Homo sapiens
MKSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 757830 - protein, 510 aa, Homo sapiens
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTSMTFFSSHLEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 757831 - protein, 289 aa, Homo sapiens
MTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 757832 - protein, 423 aa, Homo sapiens
MYTRGPGKGRGDGLGWFYLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 757833 - protein, 413 aa, Homo sapiens
AAAYYYKIRGRVDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 757834 - protein, 320 aa, Homo sapiens
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKSQHCRFSPLEPESRSGAMV

SEQ ID NO: 757835 - protein, 264 aa, Homo sapiens
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLFHKETRRTRVYGWVSSMPDLMSRSRS

SEQ ID NO: 757836 - protein, 116 aa, Homo sapiens
MKSPGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 757837 - protein, 218 aa, Homo sapiens
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQENQPANSDPREGPQDTPCTTAILNVLMEAVPVLCPLLPALTVEDIAI

SEQ ID NO: 757838 - protein, 39 aa, Homo sapiens
MAVERSVPRGGTEGSAHETIRCNRNSVLQYTHEVETGAY

SEQ ID NO: 757839 - protein, 771 aa, Homo sapiens
MVIEVKAIGGKKDRSLFLFTDLIVCTTLKRKSGSLRRSSMSLYTAASVIDTASKYKMLWKLPLEDADIIKGASQATNRENIQKAISRLDEDLTTLGQMSKLSESLGFPHQSLDDALRDLSAAMHRDLSEKQALCYALSFPPTKLELCATRPEGTDSYIFEFPHPDARLGFEQAFDEAKRKLASSKSCLDPEFLKAIPIMKTRSGMQFSCAAPTLNSCPEPSPEVWVCNSDGYVGQVCLLSLRAEPDVEACIAVCSARILCIGAVPGLQPRCHREPPPSLRSPPETAPEPAGPELDVEAAADEEAATLAEPGPQPCLHISIAGSGLEMTPGLGEGDPRPELVPFDSDSDDESSPSPSGTLQSQASRSTISSSFGNEETPSSKEATAETTSSEEEQEPGFLPLSGSFGPGGPCGTSPMDGRALRRSSHGSFTRGSLEDLLSVDPEAYQSSVWLGTEDGCVHVYQSSDSIRDRRNSMKLQHAASVTCILYLNNQVFVSLANGELVVYQREAGHFWDPQNFKSVTLGTQGSPITKMVSVGGRLWCGCQNRVLVLSPDTLQLEHMFYVGQDSSRCVACMVDSSLGVWVTLKGSAHVCLYHPDTFEQLAEVDVTPPVHRMLAGSDAIIRQHKAACLRITALLVCEELLWVGTSAGVVLTMPTSPGTVSCPRAPLSPTGLGQGHTGHVRFLAAVQLPDGFNLLCPTPPPPPDTGPEKLPSLEHRDSPWHRGPAPARPKMLVISGGDGYEDFRLSSGGGSSSETVGRDDSTNHLLLWRV

SEQ ID NO: 757840 - protein, 886 aa, Homo sapiens
HVIPHMMPIHGFQQSMRENKEKQALSDLMIKPVQRIPRYELLVKDLLKHTPEDHPDHPLLLEAQRNIKQVAERINKGVRSAEEAERHARVLQEIEAHIEGMEDLQAPLRRFLRQEMVIEVKAIGGKKDRSLFLFTDLIVCTTLKRKSGSLRRSSMSLYTAASVIDTASKYKMLWKLPLEDADIIKGASQATNRENIQKAISRLDEDLTTLGQMSKLSESLGFPHQSLDDALRDLSAAMHRDLSEKQALCYALSFPPTKLELCATRPEGTDSYIFEFPHPDARLGFEQAFDEAKRKLASSKSCLDPEFLKAIPIMKTRSGMQFSCAAPTLNSCPEPSPEVWVCNSDGYVGQVCLLSLRAEPDVEACIAVCSARILCIGAVPGLQPRCHREPPPSLRSPPETAPEPAGPELDVEAAADEEAATLAEPGPQPCLHISIAGSGLEMTPGLGEGDPRPELVPFDSDSDDESSPSPSGTLQSQASRSTISSSFGNEETPSSKEATAETTSSEEEQEPGFLPLSGSFGPGGPCGTSPMDGRALRRSSHGSFTRGSLEDLLSVDPEAYQSSVWLGTEDGCVHVYQSSDSIRDRRNSMKLQHAASVTCILYLNNQVFVSLANGELVVYQREAGHFWDPQNFKSVTLGTQGSPITKMVSVGGRLWCGCQNRVLVLSPDTLQLEHMFYVGQDSSRCVACMVDSSLGVWVTLKGSAHVCLYHPDTFEQLAEVDVTPPVHRMLAGSDAIIRQHKAACLRITALLVCEELLWVGTSAGVVLTMPTSPGTVSCPRAPLSPTGLGQGHTGHVRFLAAVQLPDGFNLLCPTPPPPPDTGPEKLPSLEHRDSPWHRGPAPARPKMLVISGGDGYEDFRLSSGGGSSSETVGRDDSTNHLLLWRV

SEQ ID NO: 757841 - protein, 228 aa, Homo sapiens
EAGLPMTHLLPRLPQHMFYVGQDSSRCVACMVDSSLGVWVTLKGSAHVCLYHPDTFEQLAEVDVTPPVHRMLAGSDAIIRQHKAACLRITALLVCEELLWVGTSAGVVLTMPTSPGTVSCPRAPLSPTGLGQGHTGHVRFLAAVQLPDGFNLLCPTPPPPPDTGPEKLPSLEHRDSPWHRGPAPARPKMLVISGGDGYEDFRLSSGGGSSSETVGRDDSTNHLLLWRV

SEQ ID NO: 757842 - protein, 2211 aa, Homo sapiens
SSLCSFTVCICSNGLPSSNLVFFALSPVQCTAPFWEPPPCFQVFHKGRTAQAAATKIETTGPQRSRSLSLQPAGLALGSSLAGGPPGETFGRATELEPGREPLLRLASSSHTPCAAFGVGPALLGMGGQGGLPRLPRGQAPPRVSYATMADGAPRPQLYRSVSFKLLERWSGGPGLREEDTDTPGLRRRASCRPTTAARGQPSRRVSKLASGPLAAPAQPRPLRSLSPSVRQLSRRFDAPRLDDGSAGTRDGGVLPAAAEEAAEGPARGAWPSVTEMRKLFGGPGSRRPSADSESPGTPSPDGAAWEPPARESRQPPTPPPRTCFPLAGLRSARPLTGPETEGRLRRPQQQQERAQRPADGLHSWHIFSQPQAGARASCSSSSIAASYPVSRSRAASSSEEEEEGPPQLPGAQSPAYHGGHSSGSDDDRDGEGGHRWGGRPGLRPGSSLLDQDCRPDSDGLNLSSMNSAGVSGSPEPPTSPRAPREEGLREWGSGSPPCVPGPQEGLRPMSDSVGGAFRVAKVSFPSYLASPAGSRGSSRYSSTETLKDDDLWSSRGSGGWGVYRSPSFGAGEGLLRSQARTRAKGPGGTSRALRDGGFEPEKSRQRKSLSNPDIASETLTLLSFLRSDLSELRVRKPGGSSGDRGSNPLDGRDSPSAGGPVGQLEPIPIPAPASPGTRPTLKDLTATLRRAKSFTCSEKPMARRLPRTSALKSSSSELLLTGPGAEEDPLPLIVQDQYVQEARQVFEKIQRMGAQQDDGSDAPPGSPDWAGDVTRGQRSQEELSGPESSLTDEGIGADPEPPVAAFCGLGTTGMWRPLSSSSAQTNHHGPGTEDSLGGWALVSPETPPTPGALRRRRKVPPSGSGGSELSNGEAGEAYRSLSDPIPQRHRAATSEEPTGFSVDSNLLGSLSPKTGLPATSAMDEGLTSGHSDWSVGSEESKGYQEVIQSIVQGPGTLGRVVDDRIAGKAPKKKSLSDPSRRGELAGPGFEGPGGEPIREVEPMLPPSSSEPILVEQRAEPEEPGATRSRAQSERALPEALPPPATAHRNFHLDPKLADILSPRLIRRGSKKRPARSSHQELRRDEGSQDQTGSLSRARPSSRHVRHASVPATFMPIVVPEPPTSVGPPVAVPEPIGFPTRAHPTLQAPSLEDVTKQYMLNLHSGEVPAPVPVDMPCLPLAAPPSAEAKPPEAARPADEPTPASKCCSKPQVDMRKHVAMTLLDTEQSYVESLRTLMQGYMQPLKQPENSVLCDPSLVDEIFDQIPELLEHHEQFLEQVRHCMQTWHAQQKVGALLVQSFSKDVLVNIYSAYIDNFLNAKDAVRVAKEARPAFLKFLEQSMRENKEKQALSDLMIKPVQRIPRYELLVKDLLKHTPEDHPDHPLLLEAQRNIKQVAERINKGVRSAEEAERHARVLQEIEAHIEGMEDLQAPLRRFLRQEMVIEVKAIGGKKDRSLFLFTDLIVCTTLKRKSGSLRRSSMSLYTAASVIDTASKYKMLWKLPLEDADIIKGASQATNRENIQKAISRLDEDLTTLGQMSKLSESLGFPHQSLDDALRDLSAAMHRDLSEKQALCYALSFPPTKLELCATRPEGTDSYIFEFPHPDARLGFEQAFDEAKRKLASSKSCLDPEFLKAIPIMKTRSGMQFSCAAPTLNSCPEPSPEVWVCNSDGYVGQVCLLSLRAEPDVEACIAVCSARILCIGAVPGLQPRCHREPPPSLRSPPETAPEPAGPELDVEAAADEEAATLAEPGPQPCLHISIAGSGLEMTPGLGEGDPRPELVPFDSDSDDESSPSPSGTLQSQASRSTISSSFGNEETPSSKEATAETTSSEEEQEPGFLPLSGSFGPGGPCGTSPMDGRALRRSSHGSFTRGSLEDLLSVDPEAYQSSVWLGTEDGCVHVYQSSDSIRDRRNSMKLQHAASVTCILYLNNQVFVSLANGELVVYQREAGHFWDPQNFKSVTLGTQGSPITKMVSVGGRLWCGCQNRVLVLSPDTLQLEHMFYVGQDSSRCVACMVDSSLGVWVTLKGSAHVCLYHPDTFEQLAEVDVTPPVHRMLAGSDAIIRQHKAACLRITALLVCEELLWVGTSAGVVLTMPTSPGTVSCPRAPLSPTGLGQGHTGHVRFLAAVQLPDGFNLLCPTPPPPPDTGPEKLPSLEHRDSPWHRGPAPARPKMLVISGGDGYEDFRLSSGGGSSSETVGRDDSTNHLLLWRV

SEQ ID NO: 757843 - protein, 2026 aa, Homo sapiens
SSLCSFTVCICSNGLPSSNLVFFALSPVQCTAPFWEPPPCFQVFHKGRTAQAAATKIETTGPQRSRSLSLQPAGLALGSSLAGGPPGETFGRATELEPGREPLLRLASSSHTPCAAFGVGPALLGMGGQGGLPRLPRGQAPPRVSYATMADGAPRPQLYRSVSFKLLERWSGGPGLREEDTDTPGLRRRASCRPTTAARGQPSRRVSKLASGPLAAPAQPRPLRSLSPSVRQLSRRFDAPRLDDGSAGTRDGGVLPAAAEEAAEGPARGAWPSVTEMRKLFGGPGSRRPSADSESPGTPSPDGAAWEPPARESRQPPTPPPRTCFPLAGLRSARPLTGPETEGRLRRPQQQQERAQRPADGLHSWHIFSQPQAGARASCSSSSIAASYPVSRSRAASSSEEEEEGPPQLPGAQSPAYHGGHSSGSDDDRDGEGGHRWGGRPGLRPGSSLLDQDCRPDSDGLNLSSMNSAGVSGSPEPPTSPRAPREEGLREWGSGSPPCVPGPQEGLRPMSDSVGGAFRVAKVSFPSYLASPAGSRGSSRYSSTETLKDDDLWSSRGSGGWGVYRSPSFGAGEGLLRSQARTRAKGPGGTSRALRDGGFEPEKSRQRKSLSNPDIASETLTLLSFLRSDLSELRVRKPGGSSGDRGSNPLDGRDSPSAGGPVGQLEPIPIPAPASPGTRPTLKDLTATLRRAKSFTCSEKPMARRLPRTSALKSSSSELLLTGPGAEEDPLPLIVQDQYVQEARQVFEKIQRMGAQQDDGSDAPPGSPDWAGDVTRGQRSQEELSGPESSLTDEGIGADPEPPVAAFCGLGTTGMWRPLSSSSAQTNHHGPGTEDSLGGWALVSPETPPTPGALRRRRKVPPSGSGGSELSNGEAGEAYRSLSDPIPQRHRAATSEEPTGFSVDSNLLGSLSPKTGLPATSAMDEGLTSGHSDWSVGSEESKGYQEVIQSIVQGPGTLGRVVDDRIAGKAPKKKSLSDPSRRGELAGPGFEGPGGEPIREVEPMLPPSSSEPILVEQRAEPEEPGATRSRAQSERALPEALPPPATAHRNFHLDPKLADILSPRLIRRGSKKRPARSSHQELRRDEGSQDQTGSLSRARPSSRHVRHASVPATFMPIVVPEPPTSVGPPVAVPEPIGFPTRAHPTLQAPSLEDVTKQYMLNLHSGEVPAPVPVDMPCLPLAAPPSAEAKPPEAARPADEPTPASKCCSKPQVDMRKHVAMTLLDTEQSYVESLRTLMQGYMQPLKQPENSVLCDPSLVDEIFDQIPELLEHHEQFLEQVRHCMQTWHAQQKVGALLVQSFSKDVLVNIYSAYIDNFLNAKDAVRVAKEARPAFLKFLEQSMRENKEKQALSDLMIKPVQRIPRYELLVKDLLKHTPEDHPDHPLLLEAQRNIKQVAERINKGVRSAEEAERHARVLQEIEAHIEGMEDLQAPLRRFLRQEMVIEVKAIGGKKDRSLFLFTDLIVCTTLKRKSGSLRRSSMSLYTAASVIDTASKYKMLWKLPLEDADIIKGASQATNRENIQKAISRLDEDLTTLGQMSKLSESLGFPHQSLDDALRDLSAAMHRDLSEKQALCYALSFPPTKLELCATRPEGTDSYIFEFPHPDARLGFEQAFDEAKRKLASSKSCLDPEFLKAIPIMKTRSGMQFSCAAPTLNSCPEPSPEVWVCNSDGYVGQVCLLSLRAEPDVEACIAVCSARILCIGAVPGLQPRCHREPPPSLRSPPETAPEPAGPELDVEAAADEEAATLAEPGPQPCLHISIAGSGLEMTPGLGEGDPRPELVPFDSDSDDESSPSPSGTLQSQASRSTISSSFGNEETPSSKEATAETTSSEEEQEPGFLPLSGSFGPGGPCGTSPMDGRALRRSSHGSFTRGSLEDLLSVDPEAYQSSVWLGTEDGCVHVYQSSDSIRDRRNSMKLQHAASVTCILYLNNQVFVSLANGELVVYQREAGHFWDPQNFKSVTLGTQGSPITKMVSVGGRLWCGCQNRVLVLSPDTLQLEVAGGGGMELVPWDELGPCDREMETMVGA

SEQ ID NO: 757844 - protein, 2211 aa, Homo sapiens; identical to SEQ ID NO: 757842

SEQ ID NO: 757845 - protein, 2211 aa, Homo sapiens; identical to SEQ ID NO: 757842

SEQ ID NO: 757846 - protein, 74 aa, Homo sapiens
TLFIRVVLAPHADFDQEYPARGTHVPAWALPCLRGSIPDGTPTGQPGHGFSRPSGCPGASSHDRVGDMWADQDL

SEQ ID NO: 757847 - protein, 2026 aa, Homo sapiens; identical to SEQ ID NO: 757843

SEQ ID NO: 757848 - protein, 134 aa, Homo sapiens
MATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWRSLLACCQLPSRPGIHLC

SEQ ID NO: 757849 - protein, 178 aa, Homo sapiens
MGDRVKGSKSRRPDLVVEVAHPKIIHESGAQILRHANLLSLRVTMATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWRSLLACCQLPSRPGIHLC

SEQ ID NO: 757850 - protein, 228 aa, Homo sapiens
MGDRVKGSKSRRPDLVVEVAHPKIIHESGAQILRHANLLVGSPSALSDQTTERQLLEASQHWDHAVFVARGALWGAEDIRRLDAAGGLRSLRVTMATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWRSLLACCQLPSRPGIHLC

SEQ ID NO: 757851 - protein, 297 aa, Homo sapiens
SSPGSQAPDTALRAMADRGPWRVGVVGYGRLGQSLVSRLLAQGPELGLELVFVWNRDPGRMAGSVPPSLQLQNLAALGERRPDLVVEVAHPKIIHESGAQILRHANLLVGSPSALSDQTTERQLLEASQHWDHAVFVARGALWGAEDIRRLDAAGGLRSLRVTMATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWRSLLACCQLPSRPGIHLC

SEQ ID NO: 757852 - protein, 215 aa, Homo sapiens
SSPGSQAPDTALRAMADRGPWRVGVVGYGRLGQSLVSRLLAQGPELGLELVFVWNLAHPKIIHESGAQILRHANLLSLRVTMATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWRSLLACCQLPSRPGIHLC

SEQ ID NO: 757853 - protein, 163 aa, Homo sapiens
MGDRVKGSKSRRPDLVVEVAHPKIIHESGAQILRHANLLVGSPSALSDQTTERQLLEASQHWDHAVFVARGALWGAEDIRRLDAAGGLRSLRVTMATHPDGFRLEGPLAAAHSPGPCTVLYEGPVRGLCPFAPRNSNTMAAAALAAPSLGFDGVIGVLVADTR

SEQ ID NO: 757854 - protein, 249 aa, Homo sapiens
SSSPPAASPGGRGPRWQRRSRAEPAARPQFPAPLAPVMAKQYDVLFRLLLIGDSGVGKTCLLCRFTDNEFHSSHISTIGVDFKMKTIEVDGIKVRIQIWDTAGQERYQTITKQYYRRAQGIFLVYDISSERSYQHIMKWVSDVDEYAPEGVQKILMGNKADEEQKRQVGREQGQQLAKEYGMDFYETSACTNLNIKESFTRLTELVLQAHRKELEGLRMRASNELALAELEEEEGKPEGPANSSKTCWC

SEQ ID NO: 757855 - protein, 160 aa, Homo sapiens
MSWHWQSWRRRRANPRAQRTLRKPAGAESCVGHPTRHPSSLRRPVGRQGSRGFALLLSSRVMTLLSISSHYSPCLALRAALLSSQAAPVPSPSTLEWSSSACFPSHRPATTPTMCRKHCLTIPHPPDNSQGWSPGHFQLLLSPCIVSLLCFFSLPPLLFL

SEQ ID NO: 757856 - protein, 249 aa, Homo sapiens; identical to SEQ ID NO: 757854

SEQ ID NO: 757857 - protein, 249 aa, Homo sapiens; identical to SEQ ID NO: 757854

SEQ ID NO: 757858 - protein, 293 aa, Homo sapiens
SSSPPAASPGGRGPRWQRRSRAEPAARPQFPAPLAPVMAKQYDVLFRLLLIGDSGVGKTCLLCRFTDNEFHSSHISTIGVDFKMKTIEVDGIKVRIQIWDTAGQERYQTITKQYYRRAQGIFLVYDISSERSYQHIMKWVSDVDEVGDATSLPGCGEGASPGKARRGPDGKANAFQEALPSTALDEDLWYAPEGVQKILMGNKADEEQKRQVGREQGQQLAKEYGMDFYETSACTNLNIKESFTRLTELVLQAHRKELEGLRMRASNELALAELEEEEGKPEGPANSSKTCWC

SEQ ID NO: 757859 - protein, 249 aa, Homo sapiens; identical to SEQ ID NO: 757854

SEQ ID NO: 757860 - protein, 249 aa, Homo sapiens; identical to SEQ ID NO: 757854

SEQ ID NO: 757861 - protein, 49 aa, Homo sapiens
MPELQGHWLLFLVPGSFPWVGWWEGPRLAGLPSCSKCGHRGDLAPGRQQ

SEQ ID NO: 757862 - protein, 1403 aa, Homo sapiens [sequence omitted]

SEQ ID NO: 757863 - protein, 313 aa, Homo sapiens
FFFVGKSEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEADVASLNRRIQLVEEELDRAQERLATALQKLEEAEKAADESERGMKVIENRAMKD

SEQ ID NO: 757864 - protein, 162 aa, Homo sapiens
MTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAERKPTIDS

SEQ ID NO: 757865 - protein, 184 aa, Homo sapiens
YRQIPNQKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREINMVVVQGDKHQMMSEGKIHRL

SEQ ID NO: 757866 - protein, 140 aa, Homo sapiens
SSVPPGRPNLGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIICKRNQGDGGARVGLTRQV

SEQ ID NO: 757867 - protein, 1599 aa, Homo sapiens [sequence omitted]

SEQ ID NO: 757868 - protein, 1599 aa, Homo sapiens [sequence omitted]

SEQ ID NO: 757869 - protein, 1512 aa, Homo sapiens [sequence omitted]

SEQ ID NO: 757870 - protein, 1630 aa, Homo sapiens
PVCPWARPEPGVPGWGVGTPRPKQLAPFVIREPGASETWNFRSGWSGAPRSQVDTLTSQPQALGCPEPVGRTVDLFLIEGHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757871 - protein, 1403 aa, Homo sapiens [sequence omitted]

SEQ ID NO: 757872 - protein, 1511 aa, Homo sapiens
MNKAPQSTGPPPAPSPGLPQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757873 - protein, 1418 aa, Homo sapiens
VGTSRIRIVLRSLWEQSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757874 - protein, 1298 aa, Homo sapiens
FFFVGKSEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757875 - protein, 1107 aa, Homo sapiens
MSFETRFKAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757876 - protein, 1086 aa, Homo sapiens
RSKDPIRLNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757877 - protein, 1221 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIALCWASVYCSVLPRVV

SEQ ID NO: 757878 - protein, 832 aa, Homo sapiens
GQVGGWVVIQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757879 - protein, 834 aa, Homo sapiens
SSVPYSERHPVQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757880 - protein, 1512 aa, Homo sapiens [sequence omitted]

SEQ ID NO: 757881 - protein, 1512 aa, Homo sapiens [sequence omitted]

SEQ ID NO: 757882 - protein, 739 aa, Homo sapiens
MDQYFNQMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757883 - protein, 679 aa, Homo sapiens
MAWLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757884 - protein, 664 aa, Homo sapiens
RYQPVTSWQDLDFEETKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757885 - protein, 656 aa, Homo sapiens
IRLGRGGGIGREKDQYYQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757886 - protein, 589 aa, Homo sapiens [sequence omitted]

SEQ ID NO: 757887 - protein, 1412 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMIVRLPSQSKETLPETH

SEQ ID NO: 757888 - protein, 1489 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIENLGIICFSHTANLSEQQIVSNTLVRALMTAVCYSAIIFETPLRVDVAVLKARAKLLQKYLCDEQKELQALYALQALVVTLEQPPNLLRMFFDALYDEDVVKYSALSIPEIL

SEQ ID NO: 757889 - protein, 1406 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEYPNLSDPARYYPHPMYQTSPTSIIDFRY

SEQ ID NO: 757890 - protein, 527 aa, Homo sapiens
EGLAPEASAAAPAPAQSPSRCKELVVRIDGARPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757891 - protein, 474 aa, Homo sapiens
PNSSQSMPGVIRPRQRQWSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757892 - protein, 473 aa, Homo sapiens
MSCTFHQQDRYRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757893 - protein, 458 aa, Homo sapiens
MASSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757894 - protein, 1339 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEGLGMELG

SEQ ID NO: 757895 - protein, 1308 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGLAGGRYR

SEQ ID NO: 757896 - protein, 1333 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREINMVVVQGDKHQMMSEGKIHRL

SEQ ID NO: 757897 - protein, 421 aa, Homo sapiens
MLFLLCTKVDLRAYTHRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757898 - protein, 1214 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQRVQELASPSSPASGTDGASYSETHAMANISGRLHTAG

SEQ ID NO: 757899 - protein, 282 aa, Homo sapiens
IRLGTSLGDEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757900 - protein, 1106 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATHELQAGGGGFA

SEQ ID NO: 757901 - protein, 272 aa, Homo sapiens
IELGPTLPVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757902 - protein, 229 aa, Homo sapiens
SSVPPGRPNLGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757903 - protein, 1000 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKVGVCVGVGDSAQV

SEQ ID NO: 757904 - protein, 127 aa, Homo sapiens
PARIPAAPARIPAAPARIPAAPREFLLLFLLHPARFLLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757905 - protein, 915 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGAPSSGSR

SEQ ID NO: 757906 - protein, 123 aa, Homo sapiens
VGTGVGCVSGVIGHVAWEGYPAARGGGERGPEQVMLELSPEGTRHEEVSGKGYSIHKSVKAREDLLRMFFDALYDEDVVKEDAFYSWESSKDPAEQQGKGVALKSVTAFFKWLREAEEESDHN

SEQ ID NO: 757907 - protein, 913 aa, Homo sapiens
PVCPWARPEPGVPGWGVGTPRPKQLAPFVIREPGASETWNFRSGWSGAPRSQVDTLTSQPQALGCPEPVGRTVDLFLIEGHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAERKPTIDS

SEQ ID NO: 757908 - protein, 905 aa, Homo sapiens
PVCPWARPEPGVPGWGVGTPRPKQLAPFVIREPGASETWNFRSGWSGAPRSQVDTLTSQPQALGCPEPVGRTVDLFLIEGHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQNLIIHLCLS

SEQ ID NO: 757909 - protein, 760 aa, Homo sapiens
PVCPWARPEPGVPGWGVGTPRPKQLAPFVIREPGASETWNFRSGWSGAPRSQVDTLTSQPQALGCPEPVGRTVDLFLIEGHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLTR

SEQ ID NO: 757910 - protein, 827 aa, Homo sapiens
PVCPWARPEPGVPGWGVGTPRPKQLAPFVIREPGASETWNFRSGWSGAPRSQVDTLTSQPQALGCPEPVGRTVDLFLIEGHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGGAISPLSRTHQPLG

SEQ ID NO: 757911 - protein, 645 aa, Homo sapiens
PVCPWARPEPGVPGWGVGTPRPKQLAPFVIREPGASETWNFRSGWSGAPRSQVDTLTSQPQALGCPEPVGRTVDLFLIEGHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEADVASLNRRIQLVEEELDRAQERLATALQKAEEAEKAADESERGMKVIENRAMKD

SEQ ID NO: 757912 - protein, 213 aa, Homo sapiens
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPELRKTRKLRGHVSHGHGRIGKHRKHPGG

SEQ ID NO: 757913 - protein, 114 aa, Homo sapiens
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGGARCL

SEQ ID NO: 757914 - protein, 71 aa, Homo sapiens
NPAVPEVENQPPAGSNPGPESEGSGVPPRPEEADETWDSKEDKIHNAENIQPGEQKYEYKSGMLKKGLRMA

SEQ ID NO: 757915 - protein, 1455 aa, Homo sapiens
ARFGSTYTKMERYREDYAWPLRKDDTQIREAVPYFIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757916 - protein, 1407 aa, Homo sapiens
RRVVGLFSANLVTLCVLQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757917 - protein, 1236 aa, Homo sapiens
MVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757918 - protein, 1184 aa, Homo sapiens
MRARTNVLDTICCSLRLAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757919 - protein, 1068 aa, Homo sapiens
LTCRRLDFPPLVLPGSPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757920 - protein, 1522 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIENLGIICFSHTANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757921 - protein, 842 aa, Homo sapiens
FFPFNGLFSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757922 - protein, 816 aa, Homo sapiens
RPLQHQKWPSQKWVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757923 - protein, 1426 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEIANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757924 - protein, 1512 aa, Homo sapiens [sequence omitted]

SEQ ID NO: 757925 - protein, 772 aa, Homo sapiens
VRYSRGPVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757926 - protein, 1512 aa, Homo sapiens [sequence omitted]

SEQ ID NO: 757927 - protein, 645 aa, Homo sapiens
MDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 757928 - protein, 80 aa, Homo sapiens
RLQSAQLKSWLCCGLSGGPGPSPAPVSSFCPMRKLGSGVPEAPVHSACLDGEALLVWQRGGCSGICISPANLEDEESSQE

SEQ ID NO: 757929 - protein, 90 aa, Homo sapiens
ASASQSAGITAVIHRARLSQKLLTGIPEAPTWAHIGWASISSPTTSCWWPQPSPFPSRSGLLWGAGPFTALAQETDPKSEASLGTPFCTQ

SEQ ID NO: 757930 - protein, 105 aa, Homo sapiens
EVLIAAVMVSLLNCVVTVSPQNMGIGKNEDLPWPPLRNEFRYFQRVTTTSSVEGKQNLVIMGRKIWFSIPEKNRPLKNRINLVLRRDHKNLHKEINFLQEVWMMP

SEQ ID NO: 757931 - protein, 841 aa, Homo sapiens
MSAQSLPAATPPTQKPPRIIRPRPPSRSRAAQSPGPPHNGSSPQELPRNSNDAPTPMCTPIFWEPPAASLKPPALLPPSASRASLDSQTSPDSPSSTPTPSPVSRRSASPEPAPRSPVPPPKPSGSPCTPLLPMAGVLAQNGSASAPGTVRRLAGRFEGGAEGRAQDADAPEPGLQARADVNGEREAPLTGSGSQENGAPDAGLACPPCCPCVCHTTRPGLELRWVPVGGYEEVPRVPRRASPLRTSRSRPHPPSIGHPAVVLTSYRSTAERKLLPLLKPPKPTRVRQDATIFGDPPQPDLDLLSEDGIQTGDSPDEAPQNTPPATVEGREEEGLEVLKEQNWELPLQDEPLYQTYRAAVLSEELWGVGEDGSPSPANAGDAPTFPRPPGPRNTLWQELPAVQASGLLDTLSPQERRMQESLFEVVTSEASYLRSLRLLTDTFVLSQALRDTLTPRDHHTLFSNVQRVQGVSERFLATLLSRVRSSPHISDLCDVVHAHAVGPFSVYVDYVRNQQYQEETYSRLMDTNVRFSAELRRLQSLPKCERLPLPSFLLLPFQRITRLRMLLQNILRQTEEGSSRQENAQKALGAVSKIIERCSAEVGRMKQTEELIRLTQRLRFHKVKALPLVSWSRRLEFQGELTELGCRRGGVLFASRPRFTPLCLLLFSDLLLITQPKSGQRLQVLDYAHRSLVQAQQVPDPSGPPTFRLSLLSNHQGRPTHRLLQASSLSDMQRWLGAFPTPGPLPCSPDTIYEDCDCSQELCSESSAPAKTEGRSLESRAAPKHLHKTPEGWLKGLPGAFPAQLVCEVTGEHERRRHLRQNQRLLEAVGPSSGTPNAPPP

SEQ ID NO: 757932 - protein, 234 aa, Homo sapiens
MSAQSLPAATPPTQKPPRIIRPRPPSRSRAAQSPGPPHNGSSPQELPRNSNDAPTPMCTPIFWEPPAASLKPPALLPPSASRASLDSQTSPDSPSSTPTPSPVSRRSASPEPAPRSPVPPPKPSGSPCTPLLPMAGVLAQNGSASAPGTVRRLAGRFEGGAEGRAQDADAPEPGLQARADVNGEREAPLTGSGSQENGAPGECGGWGALGDLNPPIFSVFSANNFQGLPFQKWS

SEQ ID NO: 757933 - protein, 98 aa, Homo sapiens
QKKIKICASPLRTSRSRPHPPSIGHPAVVLTSYRSTAERKLLPLLKPPKPTRVRQDATIFGDPPQPDLDLLSEDGIQTGDSPDEAPQNTPPATVEGRY

SEQ ID NO: 757934 - protein, 127 aa, Homo sapiens
VQRDPCCPSERPHPWAVGSGYRFWTMPIAPWSRPSRFRIHLDPLPSASPFSATTRAAPPTDYSKLLPCELCFPQKTTLGHLSDLSDLPHFPSLSLLWLLPQPQRIFWANCDTSYIYANILLLKFVFQ

SEQ ID NO: 757935 - protein, 981 aa, Homo sapiens
MSAQSLPAATPPTQKPPRIIRPRPPSRSRAAQSPGPPHNGSSPQELPRNSNDAPTPMCTPIFWEPPAASLKPPALLPPSASRASLDSQTSPDSPSSTPTPSPVSRRSASPEPAPRSPVPPPKPSGSPCTPLLPMAGVLAQNGSASAPGTVRRLAGRFEGGAEGRAQDADAPEPGLQARADVNGEREAPLTGSGSQENGAPGECGGWGALGDLNPPIFSVFSANNFQGLPFQKWSQCLGYLVSVCRDLKGVRVEEIYRCLDLDIAVAGQVKDGDGLGGGGAGPQGLSPYGYLSPTDAGLACPPCCPCVCHTTRPGLELRWVPVGGYEEVPRVPRRASPLRTSRSRPHPPSIGHPAVVLTSYRSTAERKLLPLLKPPKPTRVRQDATIFGDPPQPDLDLLSEDGIQTGDSPDEAPQNTPPATVEGREEEGLEVLKEQNWELPLQDEPLYQTYRAAVLSEELWGVGEDGSPSPANAGDAPTFPRPPGPRNTLWQELPAVQASGLLDTLSPQERRMQESLFEVVTSEASYLRSLRLLTDTFVLSQALRDTLTPRDHHTLFSNVQRVQGVSERFLATLLSRVRSSPHISDLCDVVHAHAVGPFSVYVDYVRNQQYQEETYSRLMDTNVRFSAELRRLQSLPKCERLPLPSFLLLPFQRITRLRMLLQNILRQTEEGSSRQENAQKALGAVSKIIERCSAEVGRMKQTEELIRLTQRLRFHKVKALPLVSWSRRLEFQGELTELGCRRGGVLFASRPRFTPLCLLLFSDLLLITQPKSGQRLQVLDYAHRSLVQAQQVPDPSGPPTFRLSLLSNHQGRPTHRLLQASSRELCFPQKTTLGHLSDLSDLPHFPSLSLLWLLPQPQRIFWANCDTSLSDMQRWLGAFPTPGPLPCSPDTIYEDCDCSQELCSESSAPAKTEGRSLESRAAPKHLHKTPEGWLKGLPGAFPAQLVCEVTGEHERRRHLRQNQRLLEAVGPSSGTPNAPPP

SEQ ID NO: 757936 - protein, 981 aa, Homo sapiens; identical to SEQ ID NO: 757935

SEQ ID NO: 757937 - protein, 331 aa, Homo sapiens
METRGTERAGGGDRTRDHDPMQEGDDTPCRQQQTSGPRPHRDGTTASAAAAEEGQRNVTRALTTCSAAPARQARQPPQRNDPGRRYRRARRPHPTQRGSTGAPHLEPNPRQATYTNDHRARRPRDRHADPDHPDQPSPTATDLNRHVADPPDTTPARQTPHHTSTTERMSTKPCHTKTRHTSKTKTTGVSCTRQQISDNAYDKHDGQEPETAARKLVTIGPEHEAERRTHRHKQQKALRRRRAEVTRHRASDNAAHNDHQRTTEPDTHKPTNRQNERQTQTDDDSSAHAKRQDGDNTRHRDAPETREADRGSKSDKPTQHRATGDKRPKQR

SEQ ID NO: 757938 - protein, 163 aa, Homo sapiens
VALGTSFPFFLHREEEGLEVLKEQNWELPLQDEPLYQTYRAAVLSEELWGVGEDGSPSPANAGDAPTFPRPPGPRNTLWQELPAVQASGLLDTLSPQERRMQESLFEVVTSEASYLRSLRLLTDTFVLSQALRDTLTPRDHHTLFSNVQRVQGVSERSVAFRP

SEQ ID NO: 757939 - protein, 981 aa, Homo sapiens; identical to SEQ ID NO: 757935

SEQ ID NO: 757940 - protein, 981 aa, Homo sapiens; identical to SEQ ID NO: 757935

SEQ ID NO: 757941 - protein, 1268 aa, Homo sapiens
MSAPAGSSHPAASARIPPKFGGSAVSGAAAPAGPGAGPAPHQQNGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVQYGEYVNNQASSAPTPLSSTSDDEEEEEEDEEAGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMAVDRSVSSSLSDARDALVNAVVDSLSAYGSTVSNLQHSALMAPSSLKLFPLYVLALLKQKAFRTGTSTRLDDRVYAMCQIKSQPLVHLMKMIHPNLYRIDRLTDEGAVHVNDRIVPQPPLQKLSAEKLTREGAFLMDCGSVFYIWVGKGCDNNFIEDVLGYTNFASIPQKMTHLPELDTLSSERARSFITWLRDSRPLSPILHIVKDESPAKAEFFQHLIEDRTEAAFSYYEFLLHVQQQICK

SEQ ID NO: 757942 - protein, 930 aa, Homo sapiens
HRYLFEPAEQSYYNKSVQYGEYVNNQASSAPTPLSSTSDDEEEEEEDEEAGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMAVDRSVSSSLSDARDALVNAVVDSLSAYGSTVSNLQHSALMAPSSLKLFPLYVLALLKQKAFRTGTSTRLDDRVYAMCQIKSQPLVHLMKMIHPNLYRIDRLTDEGAVHVNDRIVPQPPLQKLSAEKLTREGAFLMDCGSVFYIWVGKGCDNNFIEDVLGYTNFASIPQKMTHLPELDTLSSERARSFITWLRDSRPLSPILHIVKDESPAKAEFFQHLIEDRTEAAFSYYEFLLHVQQQICK

SEQ ID NO: 757943 - protein, 490 aa, Homo sapiens [sequence omitted]

SEQ ID NO: 757944 - protein, 992 aa, Homo sapiens
MSAPAGSSHPAASARIPPKFGGSAVSGAAAPAGPGAGPAPHQQNGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMGE

SEQ ID NO: 757945 - protein, 236 aa, Homo sapiens
MSAPAGSSHPAASARIPPKFGGSAVSGAAAPAGPGAGPAPHQQNGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAVNR

SEQ ID NO: 757946 - protein, 1233 aa, Homo sapiens
MSAPAGSSHPAASARIPPKFGGSAVSGAAAPAGPGAGPAPHQQNGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMAVDRSVSSSLSDARDALVNAVVDSLSAYGSTVSNLQHSALMAPSSLKLFPLYVLALLKQKAFRTGTSTRLDDRVYAMCQIKSQPLVHLMKMIHPNLYRIDRLTDEGAVHVNDRIVPQPPLQKLSAEKLTREGAFLMDCGSVFYIWVGKGCDNNFIEDVLGYTNFASIPQKMTHLPELDTLSSERARSFITWLRDSRPLSPILHIVKDESPAKAEFFQHLIEDRTEAAFSYYEFLLHVQQQICK

SEQ ID NO: 757947 - protein, 1233 aa, Homo sapiens; identical to SEQ ID NO: 757946

SEQ ID NO: 757948 - protein, 394 aa, Homo sapiens
MSAPAGSSHPAASARIPPKFGGSAVSGAAAPAGPGAGPAPHQQNGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVDSSSTTSSASPMPNSYDALEGGSYPDMLSSSASSPAPDP

SEQ ID NO: 757949 - protein, 236 aa, Homo sapiens; identical to SEQ ID NO: 757945

SEQ ID NO: 757950 - protein, 149 aa, Homo sapiens
IGVNTFKKIEIISSTLSDHSGIKLEINSKRNLLYHANTWKLNNLLLNEHWVKNEINMKIKKFFKLNNNNDTTYQNLWDPAKVVLRGKFIALNAYIKKSERAQTDGLRSHLKEEEKQKQTKPKPSRKKEIAKIGAELNEIETTTTTKTKR

SEQ ID NO: 757951 - protein, 273 aa, Homo sapiens
MFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFPLADHLNSTNHAIVQTLVNSVNSKIPKACCVPTELSAISMLYLDENEKVVLKNYQDMVVEGCGCR

SEQ ID NO: 757952 - protein, 396 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 757953 - protein, 337 aa, Homo sapiens
MFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 757954 - protein, 330 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAYLNMGRAR

SEQ ID NO: 757955 - protein, 396 aa, Homo sapiens; identical to SEQ ID NO: 757952

SEQ ID NO: 757956 - protein, 318 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSRLWLPRGITPFTATENALFLWLII

SEQ ID NO: 757957 - protein, 332 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFPLADHLNSTNHAIVQTLVNSVNSKIPKACCVPTELSAISMLYLDENEKVVLKNYQDMVVEGCGCR

SEQ ID NO: 757958 - protein, 105 aa, Homo sapiens
VQNLQAECRKRRLLLEDSKRLVNELNHLKEKERQYEKKQAERELQETQDQLTATIRCTKGMEGDAQKLEVENAMMRKTIKKQDDQIERLEKILQRSSLMPQVFKS

SEQ ID NO: 757959 - protein, 94 aa, Homo sapiens
QPESPHSFMSSPRAGWNLIHIGFITSYCNPLSTSQSLPQESQKFSNASVHKITCSMINSRSPGSTTKIPIWGPGMNIFINIPGDLHAGDPGAPH

SEQ ID NO: 757960 - protein, 222 aa, Homo sapiens
AKECMCSCPQAGFGLPLVWETRVAAIGVGKKGTGPKQCPVDRTGRVADFTEQYNEQYGAVRTPYTMGYGESMYYNDAYGALDYYKRYRVRSYEAVAAAAAASAYNYAEQTMSHLPQVQSTTVTSHLNSTSVDPYDRHLLPNSGAAATSAAMAAAAATTSSYYGRDRSPLRRAAAMLPTVGEGYGYGPESELSQASAATRNSLYDMARYEREQYVDRARYSAF

SEQ ID NO: 757961 - protein, 222 aa, Homo sapiens; identical to SEQ ID NO: 757960

SEQ ID NO: 757962 - protein, 222 aa, Homo sapiens; identical to SEQ ID NO: 757960

SEQ ID NO: 757963 - protein, 222 aa, Homo sapiens; identical to SEQ ID NO: 757960

SEQ ID NO: 757964 - protein, 192 aa, Homo sapiens
GWKPRPAEEFPKTLRGGFDRAKMATPMHRLIARRQAEANKQHVRCQKCLEFGHWTYECTGKRKYLHRPSRTAELKKALKEKENRLLLQQSIGETNVERKAKKKRSKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 757965 - protein, 192 aa, Homo sapiens; identical to SEQ ID NO: 757964

SEQ ID NO: 757966 - protein, 136 aa, Homo sapiens
GWKPRPAEEFPKTLRGGFDRAKMATPMHRLIARRQAFDTELQPVKTFWILIQPSIVISEANKQHVRCQKCLEFGHWTYECTGKRKYLHRPSRTAELKKALKEKENRLLLQQRSFFPPRVYQHWRNQCRKKGQEKKV

SEQ ID NO: 757967 - protein, 124 aa, Homo sapiens
GWKPRPAEEFPKTLRGGFDRAKMATPMHRLIARRQASKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 757968 - protein, 160 aa, Homo sapiens
GWKPRPAEEFPKTLRGGFDRAKMATPMHRLIARRQAFDTELQPVKTFWILIQPSIVISIGETNVERKAKKKRSKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 757969 - protein, 200 aa, Homo sapiens
GWKPRPAEEFPKTLRGGFDRAKMATPMHRLIARRQAFDTELQPVKTFWILIQPSIVISEANKQHVRCQKCLEFGHWTYECTGKRKYLHRPSRTAELKKALKEKENRLLLQQRSKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 757970 - protein, 101 aa, Homo sapiens
MKLLLTFYYMSPSHVYNSVLSNRSKSVTSSSSSSSDSSASDSSSESEETSTSSSSEDSDTDESSSSSSSSASSTTSSSSSDSDSDSSSSSSSSTSTDSSSD

SEQ ID NO: 757971 - protein, 192 aa, Homo sapiens; identical to SEQ ID NO: 757964

SEQ ID NO: 757972 - protein, 214 aa, Homo sapiens
GWKPRPAEEFPKTLRGGFDRAKMATPMHRLIARRQAFDTELQPVKTFWILIQPSIVISEANKQHVRCQKCLEFGHWTYECTGKRKYLHRPSRTAELKKALKEKENRLLLQQSIGETNVERKAKKKRSKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 757973 - protein, 114 aa, Homo sapiens
GWKPRPAEEFPKTLRGGFDRAKMATPMHRLIARRQAEANKQHVRCQKCLEFGHWTYECTGKRKYLHRPSRTAELKKALKEKENRLLLQQRSFFPPRVYQHWRNQCRKKGQEKKV

SEQ ID NO: 757974 - protein, 150 aa, Homo sapiens
GWKPRPAEEFPKTLRGGFDRAKMATPMHRLIARRQAFDTELQPVKTFWILIQPSIVISEANKQHVRCQKCLEFGHWTYECTGKRKSEIDKRTHSKTRAEQKMNRDYTRNASNLERNDLRIEDGISSTLPSKESRRKGGLDYLKQVENEQE

SEQ ID NO: 757975 - protein, 132 aa, Homo sapiens
PLLFTRATALLPQDLFILPVLGLSICKLEVLRAGKGGCEEGFGQLLLLSEVASSSRHGGLSTTGLLGYLPLICSLVRALVNRQARGAGTRRGLQRVQYQIFQTQHLCPGVSKLSSALGFIHTVKLPVYANDM

SEQ ID NO: 757976 - protein, 423 aa, Homo sapiens
PESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNTFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 757977 - protein, 77 aa, Homo sapiens
VFGGLPCHVSLKSTLSSQPLFSNRFSFFFPKDDIFSSGIQAKTTKPKSRSAQAAPEPRFEHKVSNIFDDPLNAFGGQ

SEQ ID NO: 757978 - protein, 309 aa, Homo sapiens
PESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNTFPLLEDEDDLFTDQKVKKYKRLEYTCRVI

SEQ ID NO: 757979 - protein, 423 aa, Homo sapiens; identical to SEQ ID NO: 757976

SEQ ID NO: 757980 - protein, 153 aa, Homo sapiens
ILSMAVPTIIGLSLWKEFFPRLMTELMELQEFYDPDTVELMTWIKRQAPVAAVFAGSPQLMGAIKLCTGWMVTSLPLYNDDDLLKRNENIYQIYSKRSAEDIYKILTSYKANYLIVEDAICNEVGPMRGCRVKDLLDIANGHMVCEEGDKLTY

SEQ ID NO: 757981 - protein, 353 aa, Homo sapiens
METNFSIPLNETEEVLPEPAGHTVLWIFSLLVHGVTFVFGVLGNGLVIWVAGFRMTRTVNTICYLNLALADFSFSAILPFRMVSVAMREKWPFASFLCKLVHVMIDINLFVSVYLITIIALDRCICVLHPAWAQNHRTMSLAKRVMTGLWIFTIVLTLPNFIFWTTISTTNGDTYCIFNFAFWGDTAVERLNVFITMAKVFLILHFIIGFTVPMSIITVCYGIIAAKIHRNHMIKSSRPLRVFAAVVASFFICWFPYELIGILMAVWLKEMLLNGKYKIILVLINPTSSLAFFNSCLNPILYVFMGRNFQERLIRSLPTSLERALTEVPDSAQTSNTHTTSASPPEETELQAM

SEQ ID NO: 757982 - protein, 114 aa, Homo sapiens
METAVQKSCQVSSPGSGGSWSRGGDDSRGRSPPGTKGHGREGLDELGDRGPGRCGALGRVLGAFPGTESQGIGLWIALVVFLSFLIFSTSFYISNAEQPFFKGPPTEAAKELSL

SEQ ID NO: 757983 - protein, 108 aa, Homo sapiens
GRWFRINWIGFLISEGTSSPGIRKCDPQFREEEERRPYLSGVTVRREVGKGWAPLGVPGSRQKSPGLRQSADTEFPCQRRGSTRTGSSSSGTYFIQLGAEKESWKLGN

SEQ ID NO: 757984 - protein, 110 aa, Homo sapiens
MVGLSLPTVREVRRGNARGHSAGVDPLPTAGAQPLSVDPTGARPLNPALGVLRAPRGALLGGSAAPRVPRSRGPECASPRLESESGGLLRAGGRAPKSALPPMRWPWGRR

SEQ ID NO: 757985 - protein, 200 aa, Homo sapiens
MVNQSSPMGFLLLGFSEHPALERTLFVVVFTSYLLTLVGNTLIILLSVLYPRLHSPMYFFLSDLSFLDLCFTTSCVPQMLVNLWGPKKTISFLGCSVQLFIFLSLGTTECILLTVMAFDRYVAVCQPLHYATIIHPRLCWQLASVAWVMSLVQSIVQTPSTLHLPFCPHQQIDDFLCEVPSLIRLSCGDTSYNEIQLAVS

SEQ ID NO: 757986 - protein, 122 aa, Homo sapiens
MLVNLWGPKKTISFLGCSVQLFIFLSLGTTECILLTVMAFDRYVAVCQPLHYATIIHPRLCWQLASVAWVMSLVQSIVQTPSTLHLPFCPHQQIDDFLCEVPSLIRLSCGDTSYNEIQLAVS

SEQ ID NO: 757987 - protein, 219 aa, Homo sapiens
GQAWRPAWAPPRGAGSVRTRRGRLGALELPCRPGTSVGFPGEVWGGSSVRPELQVLVLFLVVREGICERIFLIRRFKLVLARKWITHIHSMSLPFQPFKVLATETVSHKALDADIYSAIPTEKVDGTCCYVTTYKDQPYLWARLDRKPNKQAEKRFKNFLHSKENPKEFFWNVEEDFKPAPECWIPAKETEQINGNPVPDENGHIPGIMISLLVQFCVY

SEQ ID NO: 757988 - protein, 237 aa, Homo sapiens
MKRLGSVQRKMPCVFVTEVKEEPSSKREHQPFKVLATETVSHKALDADIYSAIPTEKVDGTCCYVTTYKDQPYLWARLDRKPNKQAEKRFKNFLHSKENPKEFFWNVEEDFKPAPECWIPAKETEQINGNPVPDENGHIPGWVPVEKNNKQYCWHSSVVNYEFEIALVLKHHPDDSGLLEISAVPLSDLLEQTLELIGTIHGPLGFGPENPSFFTMGFLEYLLRQVPSVKWRAHREH

SEQ ID NO: 757989 - protein, 209 aa, Homo sapiens
MPCVFVTEVKEEPSSKREHQVSTFVGKPPNQPFKVLATETVSHKALDADIYSAIPTEKVDGTCCYVTTYKDQPYLWARLDRKPNKQAEKRFKNFLHSKENPKEFFWNVEEDFKPAPECWIPAKETEQINGNPVPDENGHIPGWVPVEKNNKQYCWHSSVVNYEFEIALVLKHHPDDSGLLEISAVPLSDLLEQTLELIGTNINGNPYGE

SEQ ID NO: 757990 - protein, 325 aa, Homo sapiens
MKRLGSVQRKMPCVFVTEVKEEPSSKREHQPFKVLATETVSHKALDADIYSAIPTEKVDGTCCYVTTYKDQPYLWARLDRKPNKQAEKRFKNFLHSKENPKEFFWNVEEDFKPAPECWIPAKETEQINGNPVPDENGHIPGWVPVEKNNKQYCWHSSVVNYEFEIALVLKHHPDDSGLLEISAVPLSDLLEQTLELIGTNINGNPYGLGSKKHPLHLLIPHGAFQIRNLPSLKHNDLLSWFEDCKEGKIEGIVWHCSDGCLIKVHRHHLGLCWPIPDTYMNSRPVIINMNLNKCDSAFDIKCLFNHFLKIDNQKFVRLKDIIFDV

SEQ ID NO: 757991 - protein, 325 aa, Homo sapiens; identical to SEQ ID NO: 757990

SEQ ID NO: 757992 - protein, 208 aa, Homo sapiens
MKRLGSVQRKMPCVFVTEVKEEPSSKREHQPFKVLATETVSHKALDADIYSAIPTEKVDGTCCYVTTYKDQPYLWARLDRKPNKQAEKRFKNFLHSKENPKEFFWNVEEDFKPAPECWIPAKETEQINGNPVPDENGHIPGWVPVEKNNKQYCWHSSVVNYEFEIALVLKHHPDDSGLLEISAVPLSDLLEQTLELIGTNINGNPYGE

SEQ ID NO: 757993 - protein, 96 aa, Homo sapiens
TNSTHHIGPPEATSASSLYTDSVSVFLSSLTLHEGDFWWSKGSSSCRTCRERGTSSARYGATAHSMGKSPSRGSAAARGSSRVLRALHRYSQRPAK

SEQ ID NO: 757994 - protein, 136 aa, Homo sapiens
MPIPRRVRSFHGPHTTCLHAACGPVRASHLARTKYNNFDVYIKTRWLYGFIRFLLYFSCSLFTAALWGALAALFCLQYLGVRVLLRFQRKLSVLLLLLGRRRVDFRLVNELLVYGIHVTMLLVGGLGWCFMVFVDM

SEQ ID NO: 757995 - protein, 136 aa, Homo sapiens; identical to SEQ ID NO: 757994

SEQ ID NO: 757996 - protein, 146 aa, Homo sapiens [sequence omitted]

SEQ ID NO: 757997 - protein, 136 aa, Homo sapiens; identical to SEQ ID NO: 757994

SEQ ID NO: 757998 - protein, 158 aa, Homo sapiens
MRPPCARSPEGQGHPQARPLAPPAGPEVRDAGAAAERAPGELRAGTRPRRGPSPGQRAARDPEVAPAGALQPGGPARRGAGPVLTRSWPGPVASLRPRGNSPGSMGRAERASAETQGPGWSRGPRDPAGTQLRRVAFEWHRHGWGPGRGELQAKAGLK

SEQ ID NO: 757999 - protein, 136 aa, Homo sapiens; identical to SEQ ID NO: 757994

SEQ ID NO: 758000 - protein, 136 aa, Homo sapiens; identical to SEQ ID NO: 757994

SEQ ID NO: 758001 - protein, 136 aa, Homo sapiens; identical to SEQ ID NO: 757994

SEQ ID NO: 758002 - protein, 136 aa, Homo sapiens; identical to SEQ ID NO: 757994

SEQ ID NO: 758003 - protein, 83 aa, Homo sapiens
ASGGPQQPNLVLSPAYQQRADGTNADADPGDKRNSGGHRSGQCKHYALRCLGQKENIKENKISHWCLAGEFLKTYKSTSCSNK

SEQ ID NO: 758004 - protein, 165 aa, Homo sapiens
MTLEEFSAGEQKTERMDKVGDALEEVLSKALSQRTITVGVYEAAKLLNVDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 758005 - protein, 165 aa, Homo sapiens; identical to SEQ ID NO: 758004

SEQ ID NO: 758006 - protein, 131 aa, Homo sapiens
MTLEEFSAGEQKTESDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 758007 - protein, 98 aa, Homo sapiens
MGLRAPALLRSLAPPAAPSDPDNVVLCLLAADEDDDRDVALQIHFTLIQAFCCENDINILRVSNPGRLAELLLLETDAGPAASEGAEQPPDLHCVLVT

SEQ ID NO: 758008 - protein, 135 aa, Homo sapiens
MGLRAPALLRSLAPPAAPSDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 758009 - protein, 165 aa, Homo sapiens; identical to SEQ ID NO: 758004

SEQ ID NO: 758010 - protein, 111 aa, Homo sapiens
MLQRCTGWALELGCRASNWLHAWASLRSSSHACCGPSLTSPSGGGRLAGLFQSWSPGGSCFAKSRSSQGLPAAQNTQTGSGLPGFTARPMPLCPGIWGKAVTGQTWSGFLP

SEQ ID NO: 758011 - protein, 630 aa, Homo sapiens
MAAGVAAWLPFARAAAIGWMPVASGPMPAPPRQERKRTQDALIVLNVSGTRFQTWQDTLERYPDTLLGSSERDFFYHPETQQYFFDRDPDIFRHILNFYRTGKLHYPRHECISAYDEELAFFGLIPEIIGDCCYEEYKDRRRENAERLQDDADTDTAGESALPTMTARQRVWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQPYVTTAIISIPTPPVTTPEGDDRPESPEYSGGNIVRVSAL

SEQ ID NO: 758012 - protein, 195 aa, Homo sapiens
DPLPLWEHPASGSLPPSLCLPSPGHQERPLLSPGRPTAGSRIAGPSAWPGVSGERGSGACALGGVVIRDRSPGERGGDKGAVWGRSMSLCWHPRAPRFANSSSHRQGHGSGLLRSKGSVIGWNRAAGEETGSFCIPSTEHLMKYSIYIYKYIYKYIYILLFVGTLGKCPLVTVNMNCDPIPSRMSPVSPSSYQPP

SEQ ID NO: 758013 - protein, 170 aa, Homo sapiens
MRVSRARLRRPLLLLLLPPPQRLLGLSTPRNRPPRAARRTRCPCRPGRVGRPRAAPSYFCPATALPSQLSTCLPEVNFQKQESPEPGRGMNREGAPGKSPEEMYIQQKVRVLLMLRKMGSNLTASEEEFLRTYAGVVNSQLSQLPPHSIDQGAEDVVMAFSRSETEDRRQ

SEQ ID NO: 758014 - protein, 40 aa, Homo sapiens
MNREGAPGKSPEEMYIQQKVRVLLMLRKMGSNECLWGVRQ

SEQ ID NO: 758015 - protein, 243 aa, Homo sapiens
DWYNHGWAQIEDQGEKAAGTRQKKVLRSELGGFGQAGRSAGRPSQPAGARCRPPPAGPSPGGLAPPSLPNRGDSRSGRRRLRRPLLLLLLPPPQRLLGLSTPRNRPPRAARRTRCPCRPGRVGRPRAAPSYFCPATALPSQLSTCLPEVNFQKQESPEPGRGMNREGAPGKSPEEMYIQQKVRVLLMLRKMGSNLTASEEEFLRTYAGVVNSQLSQLPPHSIDQGAEDVVMAFSRSETEDRRQ

SEQ ID NO: 758016 - protein, 132 aa, Homo sapiens
PEVWVQVSWACQTHRAAPSYFCPATALPSQLSTCLPEVNFQKQESPEPGRGMNREGAPGKSPEEMYIQQKVRVLLMLRKMGSNLTASEEEFLRTYAGVVNSQLSQLPPHSIDQGAEDVVMAFSRSETEDRRQ

SEQ ID NO: 758017 - protein, 73 aa, Homo sapiens
GDTGIVYTPAETTAVLYGLGSEAEAAAPAAATAAAAAAARAEHAPEQAAARCAPDPLPLPARPGRAAQVQRTW

SEQ ID NO: 758018 - protein, 243 aa, Homo sapiens; identical to SEQ ID NO: 758015

SEQ ID NO: 758019 - protein, 106 aa, Homo sapiens
MCCVSEHTRVHTHTHVHTHALSPLRGLEVWLSPWGKVSSFISLLQVGVPGVRCRGHIAGCPLFVAPIKGPHLVDTWLSVWSLPQPVLVTITGLAFVTMMTPACLIF

SEQ ID NO: 758020 - protein, 243 aa, Homo sapiens; identical to SEQ ID NO: 758015

SEQ ID NO: 758021 - protein, 106 aa, Homo sapiens; identical to SEQ ID NO: 758019

SEQ ID NO: 758022 - protein, 132 aa, Homo sapiens
LVTHQEFLSRYRFPQAAPSYFCPATALPSQLSTCLPEVNFQKQESPEPGRGMNREGAPGKSPEEMYIQQKVRVLLMLRKMGSNLTASEEEFLRTYAGVVNSQLSQLPPHSIDQGAEDVVMAFSRSETEDRRQ

SEQ ID NO: 758023 - protein, 145 aa, Homo sapiens
MAVLYGLGSEAEAAAPAAATAAAAAAARAEHAPEQAAARCAPDPLPLPARPGRAAQESPEPGRGMNREGAPGKSPEEMYIQQKVRVLLMLRKMGSNLTASEEEFLRTYAGVVNSQLSQLPPHSIDQGAEDVVMAFSRSETEDRRQ

SEQ ID NO: 758024 - protein, 182 aa, Homo sapiens
GDTGKCKPRLKRRQYYTVKVARLRRPLLLLLLPPPQRLLGLSTPRNRPPRAARRTRCPCRPGRVGRPRAAPSYFCPATALPSQLSTCLPEVNFQKQESPEPGRGMNREGAPGKSPEEMYIQQKVRVLLMLRKMGSNPALPHPTSQLLSGAGIKGDTSGAFIIGLKGWTCDWLQEETFLFFKS

SEQ ID NO: 758025 - protein, 243 aa, Homo sapiens; identical to SEQ ID NO: 758015

SEQ ID NO: 758026 - protein, 243 aa, Homo sapiens; identical to SEQ ID NO: 758015

SEQ ID NO: 758027 - protein, 114 aa, Homo sapiens
QQAGWDPLRRSWSATGRSLNLDPVGTGEPRRASSRRRCRRLCVRLERKVGTCSQASPPVSFDSQVRQSRPTPWLGSPGPLHLGLSQGWGWGRLSVATTPCNTQGGRGCGCQGTG

SEQ ID NO: 758028 - protein, 156 aa, Homo sapiens [sequence omitted]

SEQ ID NO: 758029 - protein, 156 aa, Homo sapiens [sequence omitted]

SEQ ID NO: 758030 - protein, 156 aa, Homo sapiens [sequence omitted]

SEQ ID NO: 758031 - protein, 242 aa, Homo sapiens
MPVGPAFSPSRRTSKGSVCPGCAGLQAGAGPSPDWKMRLTSWPRSLPGRSLDTQLRPYPRTDSGSRSLPPWASRHGGRGWSWGLPSTPGNPHAHAPHLPGLPLLILAFCVAGAAALSVASLCWCRLQREIRLTQKADYATAKAPGSPAAPRISPGDQRLAQSAEMYHYQHQRQQMLCLERHKEPPKELDTASSDEENEDGDFTVYECPGLAPTGEMEVRNPLFDHAALSAPLPAPSSPPALP

SEQ ID NO: 758032 - protein, 156 aa, Homo sapiens [sequence omitted]

SEQ ID NO: 758033 - protein, 187 aa, Homo sapiens
MATPLPPPSPRHLRLLRLLLSGLVLGAALRGAAAGHPDVAACPGSLDCALKRRARCPPGAHACGPCLQPFQEDQQGLCVPRMRRPPGGGRPQPRLEDEIDFLAQELARKESGHSTPPLPKDRQRLPEPATLGFSARGQGLELGPPLHSREPPRPRPTPPWAPLCHPTRCTCRPWSPGEGKATASPLC

SEQ ID NO: 758034 - protein, 146 aa, Homo sapiens
MATPLPPPSPRHLRLLRLLLSGLVLGAALRGAAAGHPDVAACPGSLDCALKRRARCPPGAHACGPCLQPFQEDQQGLCVPRMRRPPGGGRPQPRLEDEIDFLAQELARKESGHSTPPLPKDRQRLPEPATLGFSARGQGLELGPPC

SEQ ID NO: 758035 - protein, 156 aa, Homo sapiens [sequence omitted]

SEQ ID NO: 758036 - protein, 156 aa, Homo sapiens [sequence omitted]

SEQ ID NO: 758037 - protein, 156 aa, Homo sapiens [sequence omitted]

SEQ ID NO: 758038 - protein, 187 aa, Homo sapiens; identical to SEQ ID NO: 758033

SEQ ID NO: 758039 - protein, 112 aa, Homo sapiens
AFPTTVTVTSSTEVLNPSRLPMKVRINFFQTPFHVDSSSIIRQQMLCLERHKEPPKELDTASSDEENEDGDFTVYECPGLAPTGEMEVRNPLFDHAALSAPLPAPSSPPALP

SEQ ID NO: 758040 - protein, 137 aa, Homo sapiens
FPPPLANFTPGPATLTCTLTFTSPAALTLTSPGQLHPGLCSPATPGLRWAECPLPDWATGTSRAWGGPSDPPPPRHKEPPKELDTASSDEENEDGDFTVYECPGLAPTGEMEVRNPLFDHAALSAPLPAPSSPPALP

SEQ ID NO: 758041 - protein, 92 aa, Homo sapiens
SWYSEDPRLGITRGHFSIPAQREQMLCLERHKEPPKELDTASSDEENEDGDFTVYECPGLAPTGEMEVRNPLFDHAALSAPLPAPSSPPALP

SEQ ID NO: 758042 - protein, 106 aa, Homo sapiens
MFNVPKSRPTDTGGCCPRLWRVCGAWRWLLCPPATAAAGTALKEGGQPEGPECQVTKETKPANQGLEKDDAPCGPRGPACSVQCGAGQRGRVLVSQRCHRRLPRQG

SEQ ID NO: 758043 - protein, 82 aa, Homo sapiens
IAVPEDPVVSTRQQMLCLERHKEPPKELDTASSDEENEDGDFTVYECPGLAPTGEMEVRNPLFDHAALSAPLPAPSSPPALP

SEQ ID NO: 758044 - protein, 156 aa, Homo sapiens [sequence omitted]

SEQ ID NO: 758045 - protein, 156 aa, Homo sapiens [sequence omitted]

SEQ ID NO: 758046 - protein, 156 aa, Homo sapiens [sequence omitted]

SEQ ID NO: 758047 - protein, 187 aa, Homo sapiens; identical to SEQ ID NO: 758033

SEQ ID NO: 758048 - protein, 352 aa, Homo sapiens
MATPLPPPSPRHLRLLRLLLSGLVLGAALRGAAAGHPDVAACPGSLDCALKRRARCPPGAHACGPCLQPFQEDQQGLCVPRMRRPPGGGRPQPRLEDEIDFLAQELARKESGHSTPPLPKDRQRLPEPGGDPRFPCPTALSLAQCSHSNLSSLSSHPGLLGTGAGAGAGASPPLQGTPTPTPHTSLGSPVSSDPVHMSPLEPRGGQGDGLALVLILAFCVAGAAALSVASLCWCRLQREIRLTQKADYATAKAPGSPAAPRISPGDQRLAQSAEMYHYQHQRQQMLCLERHKEPPKELDTASSDEENEDGDFTVYECPGLAPTGEMEVRNPLFDHAALSAPLPAPSSPPALP

SEQ ID NO: 758049 - protein, 156 aa, Homo sapiens [sequence omitted]

SEQ ID NO: 758050 - protein, 148 aa, Homo sapiens
CRRIGISPLLILAFCVAGAAALSVASLCWCRLQREIRLTQKADYATAKAPGSPAAPRISPGDQRLAQSAEMYHYQHQRQQMLCLERHKEPPKELDTASSDEENEDGDFTVYECPGLAPTGEMEVRNPLFDHAALSAPLPAPSSPPALP

SEQ ID NO: 758051 - protein, 129 aa, Homo sapiens
MSPLEPRGGQGDGLALVLILAFCVAGAAALSVASLCWCRLQREIRLTQKADYATAKAPGSPAAPRISPGDQRLAQSAEMYHYQHQRQQMLCLERHKEPPKELDTASSDEENEDGDFTVYECPGLAPVPQ

SEQ ID NO: 758052 - protein, 111 aa, Homo sapiens
IAVPEDPVSAYGNRCCAWSGLRWAECPLPDWATGTSRAWGGPSDPPPPRHKEPPKELDTASSDEENEDGDFTVYECPGLAPTGEMEVRNPLFDHAALSAPLPAPSSPPALP

SEQ ID NO: 758053 - protein, 82 aa, Homo sapiens; identical to SEQ ID NO: 758043

SEQ ID NO: 758054 - protein, 169 aa, Homo sapiens
EPHEGPEQDRVPPADPNMSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 758055 - protein, 782 aa, Homo sapiens
TAESSLGATEEPRANPQPYLGLVLELLRRVVAALTEGMRPDSHPYGFPWELVIRAAVAGFFAVLFLWRSFRSVTSRLYVRREKKFAVALSGLIEEKCKLLEKFSLVQKEYEGYEVESSLKNASFEKEATEAQSLEATCEKLNRFNSELVHEILCLEKELKEEKSKHSEQNELMADISKRIQSLEDESKSLKSQVAEAKMTFKRFQANEERLEIEIQDAWKENSELQESQKQLLQEAEVWKEQVSELIKQKRTFEDSKVHAEQVLNDKENHIKTLTERLLKMKDGVAMLEEDVTDDDNLELEMNSESEDGAYLDNPPKGALKKLIHAAKLNASLKTLEGERNQIYIQLSEVDKTKEELTEHIKNLQTEQASLQSENTHFESENQKLQQKLKVMTELYQENEMKLYRKLIVEEKCRLEKEEKLSKVDEMISHATEELETYRKRAKDLKEFEKTIHFYQKKIILHEKKAHDNWSAAWTAERNLNDLRKENAHNRQKLTEIEFKIKLLEKDPYGLDVPNTAFGRQHSPYGPSPLGWPSSETRASLYPPTLLEGPLRLSPLLPRGGGRGSRGPGNPPDHQITKERGESSCDRLTDPHRAPSDAGPLAPPWEQDYRMMFPPPGQSYPDSALPPQRQDRFYSNCARLSGPAELRSFNMPSLDKMDGSMPSEMESSRNDTKDNLGNLKVPDSSLPAENEATGPGFVPPPLAPIRGLLFPVDTRGPFIRRGPPFPPPPPGTVFGASPDYFSPRDVPGPPRAPFAMRNVYLPRGFLPYRPPRPAFFPPAPTF

SEQ ID NO: 758056 - protein, 782 aa, Homo sapiens; identical to SEQ ID NO: 758055

SEQ ID NO: 758057 - protein, 153 aa, Homo sapiens
ARSSVFLPGYAGLCMSSCSELATGRAEGVDSRVPGLPSSLFLRTPTAAAPGESAPKFRGTAPQRPGGKGNGAVNVSNSDPLSRSELVSRGHLRAAGHSLPGAFLGPIHRASTGFHGACKLETLMPQICGVLPPAHPPLPRLGLKAPSLPLLTP

SEQ ID NO: 758058 - protein, 96 aa, Homo sapiens
LIGRLGLVGTSKKAKQREVWTLPSPPPWKTGCSSHCGVSAGVCFLPRLNGQHEEVGTDVTHVLQWKNLRLKEILSFKIASQTKTPMETLWKGLCSV

SEQ ID NO: 758059 - protein, 478 aa, Homo sapiens
MSSGRRRGSAPWHSFSRFFAPRSPSRDKEEEEEERPGTSPPPAPGRSAASHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 758060 - protein, 915 aa, Homo sapiens
MRFRRNAASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 758061 - protein, 567 aa, Homo sapiens
LFGRPTRADRRVLGTEPRLAAGSFRGSVKRSAAPAGASQVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 758062 - protein, 999 aa, Homo sapiens
TDLLLRIKDISHFLMQDIAFLSGGRGKDNAWIITFPENCNFRCIPEEVIAKVLTYLTSIARQNGSDSRFTIILDRRLDTWSSLKISLQKISASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 758063 - protein, 941 aa, Homo sapiens
MAEANPRRGKMRFRRNAASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQVGVGYSFFQACKLFSKGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 758064 - protein, 1274 aa, Homo sapiens
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFECSNFNLTVHEAMGTGDLDLLSAFRRTSLAGGGRRISDSHEDTGILDFSSLLKKRDSCGTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALRELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 758065 - protein, 83 aa, Homo sapiens
EGPSVRSFSHSTNITGMLPEPSGNRTGFSAQKEPRSGGDGGRCIQQISCDTAVHEPCPECRGSTEQRAIPVPGGDAFRRLRRW

SEQ ID NO: 758066 - protein, 1189 aa, Homo sapiens
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFECSNFNLTVHEAMGTGDLDLLSAFRRTSLAGGGRRISDSHEDTGILDFSSLLKKRDSCGTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALRELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGIYVCRATNLQGEARCECRLEVRVPQ

SEQ ID NO: 758067 - protein, 975 aa, Homo sapiens
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFECSNFNLTVHEAMGTGDLDLLSAFRRTSLAGGGRRISDSHEDTGILDFSSLLKKRDSCGTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALRELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILRECPFVQ

SEQ ID NO: 758068 - protein, 71 aa, Homo sapiens
RDPRDSKLEAPAEEDVWEILRQAPPSEYERIAFQYGVTDLRGMLKRLKGMRRDEKKSTGYPSSEGRGEGTG

SEQ ID NO: 758069 - protein, 108 aa, Homo sapiens
GSDLDLTPTLHPTQLLCETEGRVRVETTKDRSIFTVEGAEKEDEGVYTVTVKNPVGEDQVNLTVKVIGEAGRGPSWRTQRGSPKEGPSVRSFSHSTNITGMLPEPSGN

SEQ ID NO: 758070 - protein, 117 aa, Homo sapiens
MERSTTPTSPEGTDQNRRERRDRGCCDWRLMGLHRAPSSHPTVFLHICSAHHSPALEFSALPLLPSPPRQTGFIQPPGRPTHLLLQQAALPRCTAQRIKCIYLPEDMTKAIPGVAFM

SEQ ID NO: 758071 - protein, 207 aa, Homo sapiens
WAFGTAEEQCPAMAGARRLELGEALALGSGWRHACHALLYAPDPGMLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVLGLVRVPLYTLRDGVGGLPTFLENSFIGSAREQLLEALQDLGLLQSGSISGLKIPAHH

SEQ ID NO: 758072 - protein, 207 aa, Homo sapiens; identical to SEQ ID NO: 758071

SEQ ID NO: 758073 - protein, 203 aa, Homo sapiens
PQLSPDGLLWGAPANPRFPLPQMQMRFDGRLGFPGGFVDTQDRSLEDGLNRELREELGEAAAAFRVERTDYRSSHVGSGPRVVAHFYAKRLTLEELLAVEAGATRAKDHGLEVGPAWDSVPFPISSSPKAFSPPRKHPWRKVFAPLTLPSPQLSWWSWDRDHLYSELVLPTWAFCKGLSHPLPGEILSRTHSSMSLCCSLLTV

SEQ ID NO: 758074 - protein, 207 aa, Homo sapiens; identical to SEQ ID NO: 758071

SEQ ID NO: 758075 - protein, 239 aa, Homo sapiens
WAFGTAEEQCPAMAGARRLELGEALALGSGWRHACHALLYAPDPGMLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVGPAWDSVPFPISSSPKAFSPPRKHPWRKVFAPLTLPSPQLSWWSWDRDHLYSELVLPTWAFCKGLSHPLPGEILSRTHSSMSLCCSLLTV

SEQ ID NO: 758076 - protein, 207 aa, Homo sapiens; identical to SEQ ID NO: 758071

SEQ ID NO: 758077 - protein, 207 aa, Homo sapiens; identical to SEQ ID NO: 758071

SEQ ID NO: 758078 - protein, 80 aa, Homo sapiens
YTHAMTHEKGKGENTNYPGAGLFRLFLQKEKSFSSCAGFLCAAEPGPSAACSLGKGADSGAPSRPQSKRGEPRRRSWHCR

SEQ ID NO: 758079 - protein, 80 aa, Homo sapiens; identical to SEQ ID NO: 758078

SEQ ID NO: 758080 - protein, 80 aa, Homo sapiens; identical to SEQ ID NO: 758078

SEQ ID NO: 758081 - protein, 269 aa, Homo sapiens
LNAARVWRLRTRQTNIQSCWNATETGSQTGHARPALGSRQVVRDMTSEFFSAQLRAQISDDTTHPISYYKPEFYMPDDGGTAHLSVVAEDGSAVSATSTINLYFGSKVRSPVSGILLNNEMDDFSSTSITNEFGVPPSPANFIQPGKQPLSSMCPTIMVGQDGQVRMVVGAAGGTQITMATALAIIYNLWFGYDVKWAVEEPRLHNQLLPNVTTVERNIDQEVTAALETRHHHTQITSTFIAVVQAIVRMAGGWAAASDSRKGGEPAGY

SEQ ID NO: 758082 - protein, 225 aa, Homo sapiens
MTSEFFSAQLRAQISDDTTHPISYYKPEFYMPDDGGTAHLSVVAEDGSAVSATSTINLYFGSKVRSPVSGILLNNEMDDFSSTSITNEFGVPPSPANFIQPGKQPLSSMCPTIMVGQDGQVRMVVGAAGGTQITMATALAIIYNLWFGYDVKWAVEEPRLHNQLLPNVTTVERNIDQEVTAALETRHHHTQITSTFIAVVQAIVRMAGGWAAASDSRKGGEPAGY

SEQ ID NO: 758083 - protein, 210 aa, Homo sapiens
MVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 758084 - protein, 102 aa, Homo sapiens
MEPRAMCPPVGAMRGSRRDPASSSLSPDHLAQLQPGAGFLFCSAPALSGSFPPRPHHRVTWQLLAPGFATSSGPRTGTCSVWTQERGSLGGHRLGRFRKVCG

SEQ ID NO: 758085 - protein, 983 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 758086 - protein, 539 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDCMYYFNAV

SEQ ID NO: 758087 - protein, 983 aa, Homo sapiens; identical to SEQ ID NO: 758085

SEQ ID NO: 758088 - protein, 983 aa, Homo sapiens; identical to SEQ ID NO: 758085

SEQ ID NO: 758089 - protein, 666 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAVLTSEQLHDAEGFSLAGFNVSSQECTFLQHGACGSKC

SEQ ID NO: 758090 - protein, 712 aa, Homo sapiens
MGMRIKLQSTNHPNNLLKELNKCRLSETMCDVTIVVGSRSFPAHKAVLACAAGYFQNLFLNTGLDAARTYVVDFITPANFEKVLSFVYTSELFTDLINVGVIYEVAERLGMEDLLQACHSTFPDLESTARAKPLTSTSESHSGTLSCPSAEPAHPLGELRGGGDYLGADRNYVLPSDAGGSYKEEEKNVASDANHSLHLPQPPPPPPKTEDHDTPAPFTSIPSMMTQPLLGTVSTGIQTSTSSCQPYKVQSNGDFSKNSFLTPDNAVDITTGTNSCLSNSEHSKDPGFGQMDELQLEDLGDDDLQFEDPAEDIGTTEEVIELSDDSEDELAFGENDNRENKAMPCQVCKKVLEPNIQLIRQHARDHVDLLTGNCKVCETHFQDRNSRVTHVLSHIGIFLFSCDMCETKFFTQWQLTLHRRDGIFENNIIVHPNDPLPGKLGLFSGAASPELKCAACGKVLAKDFHVVRGHILDHLNLKGQACSVCDQRHLNLCSLMWHTLSHLGISVFSCSVCANSFVDWHLLEKHMAVHQSLEDALFHCRLCSQSFKSEAAYRYHVSQHKCNSGLDARPGFGLQHPALQKRKLPAEEFLGEELALQGQPGNSKYSCKVCGKRFAHTSEFNYHRRIHTGEKPYQCKVCHKFFRGRSTIKCHLKTHSGALMYRCTVCGHYSSTLNLMSKHVGVHKGSLPPDFTIEQTFMYIIHSKEADKNPDS

SEQ ID NO: 758091 - protein, 712 aa, Homo sapiens; identical to SEQ ID NO: 758090

SEQ ID NO: 758092 - protein, 157 aa, Homo sapiens
GGVVCVRACVAGGSHCLFNSCCCCTSASLPARERHEWPGPAAAAAAAAAAARRSQTQREQTEKETNTPKKKESKVSMSKNSKLLSTSAKRIQKELADITLDPPPNCSAGPKGDNIYEWRSTILGPPGSVYEGGVFFLDITFTPEYPFKPPKVRNLPV

SEQ ID NO: 758093 - protein, 193 aa, Homo sapiens
MSDDDSRASTSSSSSSSSNQQTEKETNTPKKKESKVSMSKNSKLLSTSAKRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 758094 - protein, 188 aa, Homo sapiens
PRLAGHSGPRGLVGSGHVGFVTEDSGRVVVLSEASDLRPVGGALPGIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 758095 - protein, 160 aa, Homo sapiens
MKEVGRPREVRGRPGKSRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 758096 - protein, 175 aa, Homo sapiens
MSDDDSRASTSSSSSSSSNQQTEKETNTPKKKESKVSMSKITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 758097 - protein, 65 aa, Homo sapiens
AGWYPRGIDNWSPALTISKVLLSICSLLTDCNPADPLVGSIATQYMTNRAEHDRMARQWTKRYAT

SEQ ID NO: 758098 - protein, 193 aa, Homo sapiens; identical to SEQ ID NO: 758093

SEQ ID NO: 758099 - protein, 193 aa, Homo sapiens; identical to SEQ ID NO: 758093

SEQ ID NO: 758100 - protein, 232 aa, Homo sapiens
GGVVCVRACVAGGSHCLFNSCCCCTSASLPARERHEWPGPAAAAAAAAAAARRSQTQREQTEKETNTPKKKESKVSMSKNSKLLSTSAKRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 758101 - protein, 193 aa, Homo sapiens; identical to SEQ ID NO: 758093

SEQ ID NO: 758102 - protein, 193 aa, Homo sapiens
MSDDDSRASTSSSSSSSSNQQTEKETNTPKKKESKVSMSKNSKLLSTSAKRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRYYSVLFPKILL

SEQ ID NO: 758103 - protein, 866 aa, Homo sapiens
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPEGIRDKVSDWDEFLRQTLIGACSPPVPLLEGLRNGRNPLDLIAPGSRLECQAFQDSLSTWIVTVVENIGGRLKLRYEGLESSDNYEHWLYYLDPFLHHVGWAAQQGYELQPPSAIRHLKNEAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKEIRIEVAERLHLDSNPLKWSVADVVRFIRSTDCAPLARIFLDQEIDGQALLLLTLPTVQECMDLKLGPAIKLCHHIERIKFAFYEQFAN

SEQ ID NO: 758104 - protein, 824 aa, Homo sapiens
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPEGIRDKVSDWDEFLRQTLIGACSPPVPLLEGLRNGRNPLDLIAPGSRLECQAFQDSLSTWIVTVVENIGGRLKLRYEGLESSDNYEHWLYYLDPFLHHVGWAAQQGYELQPPSAIRHLKNEAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKQEIDGQALLLLTLPTVQECMDLKLGPAIKLCHHIERIKFAFYEQFAN

SEQ ID NO: 758105 - protein, 824 aa, Homo sapiens; identical to SEQ ID NO: 758104

SEQ ID NO: 758106 - protein, 824 aa, Homo sapiens; identical to SEQ ID NO: 758104

SEQ ID NO: 758107 - protein, 866 aa, Homo sapiens; identical to SEQ ID NO: 758103

SEQ ID NO: 758108 - protein, 344 aa, Homo sapiens
MQLPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKEIRIEVAERLHLDSNPLKWSVADVVRFIRSTDCAPLARIFLDQEIDGQALLLLTLPTVQECMDLKLGPAIKLCHHIERIKFAFYEQFAN

SEQ ID NO: 758109 - protein, 866 aa, Homo sapiens; identical to SEQ ID NO: 758103

SEQ ID NO: 758110 - protein, 824 aa, Homo sapiens; identical to SEQ ID NO: 758104

SEQ ID NO: 758111 - protein, 570 aa, Homo sapiens
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPEGIRDKVSDWDEFLRQTLIGACSPPVPLLEGLRNGRNPLDLIAPGSRLECQAFQDSLSTWIVTVVENIGGRLKLRYEGLESSDNYEHWLYYLDPFLHHVGWAAQQGYELQPPSAIRHLKNEAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLQTQPCPSGAPAGQRLCVARMWGSPKSQI

SEQ ID NO: 758112 - protein, 627 aa, Homo sapiens
MNAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKEIRIEVAERLHLDSNPLKWSVADVVRFIRSTDCAPLARIFLDQEIDGQALLLLTLPTVQECMDLKLGPAIKLCHHIERIKFAFYEQFAN

SEQ ID NO: 758113 - protein, 866 aa, Homo sapiens; identical to SEQ ID NO: 758103

SEQ ID NO: 758114 - protein, 165 aa, Homo sapiens
IPDEGQANGRSARGGGTRASGIRPLLRSCHLVRASHVRATAARFAGPVLQVRPANPSGIPAALSTTRGEAQAGSGLGQGGHWVPGDASPLPGRSARGHSAVGGPRRRRVSCATASGPSAPSCWLGAWVARGAGPPAHQPAESLPPARPQPGGMALGRERGSRARE

SEQ ID NO: 758115 - protein, 121 aa, Homo sapiens
MGRIFLDHIGGTRLFSCANCDTILTNRSELISTRFTGATGRAFLFNKVVNLQYSEVQDRVMLTGRHMVRDVSCKNCNSKLGWIYEFATEDSQRYKEGRVILERALVRESEGFEEHVPSDNS

SEQ ID NO: 758116 - protein, 121 aa, Homo sapiens; identical to SEQ ID NO: 758115

SEQ ID NO: 758117 - protein, 121 aa, Homo sapiens; identical to SEQ ID NO: 758115

SEQ ID NO: 758118 - protein, 121 aa, Homo sapiens; identical to SEQ ID NO: 758115

SEQ ID NO: 758119 - protein, 121 aa, Homo sapiens; identical to SEQ ID NO: 758115

SEQ ID NO: 758120 - protein, 121 aa, Homo sapiens; identical to SEQ ID NO: 758115

SEQ ID NO: 758121 - protein, 121 aa, Homo sapiens; identical to SEQ ID NO: 758115

SEQ ID NO: 758122 - protein, 121 aa, Homo sapiens; identical to SEQ ID NO: 758115

SEQ ID NO: 758123 - protein, 121 aa, Homo sapiens; identical to SEQ ID NO: 758115

SEQ ID NO: 758124 - protein, 121 aa, Homo sapiens; identical to SEQ ID NO: 758115

SEQ ID NO: 758125 - protein, 121 aa, Homo sapiens; identical to SEQ ID NO: 758115

SEQ ID NO: 758126 - protein, 121 aa, Homo sapiens; identical to SEQ ID NO: 758115

SEQ ID NO: 758127 - protein, 177 aa, Homo sapiens
APLGCRVSPPGGRPGRPSSASFGLRPSLRLQSGGWACPCNPFPVPSLQVFRTSAIKMGRIFLDHIGGTRLFSCANCDTILTNRSELISTRFTGATGRAFLFNKVVNLQYSEVQDRVMLTGRHMVRDVSCKNCNSKLGWIYEFATEDSQRYKEGRVILERALVRESEGFEEHVPSDNS

SEQ ID NO: 758128 - protein, 121 aa, Homo sapiens; identical to SEQ ID NO: 758115

SEQ ID NO: 758129 - protein, 121 aa, Homo sapiens; identical to SEQ ID NO: 758115

SEQ ID NO: 758130 - protein, 121 aa, Homo sapiens; identical to SEQ ID NO: 758115

SEQ ID NO: 758131 - protein, 121 aa, Homo sapiens; identical to SEQ ID NO: 758115

SEQ ID NO: 758132 - protein, 140 aa, Homo sapiens
GGSHRRSGDLLVFRTSAIKMGRIFLDHIGGTRLFSCANCDTILTNRSELISTRFTGATGRAFLFNKVVNLQYSEVQDRVMLTGRHMVRDVSCKNCNSKLGWIYEFATEDSQRYKEGRVILERALVRESEGFEEHVPSDNS

SEQ ID NO: 758133 - protein, 128 aa, Homo sapiens
MKLQLCLWSLYFLTKFGGTRLFSCANCDTILTNRSELISTRFTGATGRAFLFNKVVNLQYSEVQDRVMLTGRHMVRDVSCKNCNSKLGWIYEFATEDSQRYKEGRVILERALVRESEGFEEHVPSDNS

SEQ ID NO: 758134 - protein, 121 aa, Homo sapiens; identical to SEQ ID NO: 758115

SEQ ID NO: 758135 - protein, 83 aa, Homo sapiens
PRPQYGLEKVFVITCALVQDRVMLTGRHMVRDVSCKNCNSKLGWIYEFATEDSQRYKEGRVILERALVRESEGFEEHVPSDNS

SEQ ID NO: 758136 - protein, 121 aa, Homo sapiens; identical to SEQ ID NO: 758115

SEQ ID NO: 758137 - protein, 224 aa, Homo sapiens
RLTLRPNQGEAGPRPGLTKPGDSGGRGASYQLKSDKPLAAADLTAAQEICWLNSEAFLFSRSLLDEDARRACTVVSRIRLSPVIEILGEQFFPVTLYRVSYPCVVLLWWQQLVDDESLILTRLENLIVHRPLAHGRLHVAVRMLPLCTAKVVNLQYSEVQDRVMLTGRHMVRDVSCKNCNSKLGWIYEFATEDSQRYKEGRVILERALVRESEGFEEHVPSDNS

SEQ ID NO: 758138 - protein, 143 aa, Homo sapiens
LSIQKCRSAASCEITATCSICSVRSSPAGLQPEYANREGRKFPGQAVEGEIIWICLKGERIKRADISGRNNVQACNWNLNEYLLSMLTAGAFPPICPQLHTQTSGSTEKTSAPTPGASGAGFYLHFSGFKYFENFFKKHFSLL

SEQ ID NO: 758139 - protein, 594 aa, Homo sapiens
MSKKRKWDDDYVRYWFTCTTEVDGTQRPQCVLCNSVFSNADLRPSKLSDHFNRQHGGVAGHDLNSLKHMPAPSDQSETLKAFGVASHEDTLLQASYQFAYLCAKEKNPHTVAEKLVKPCALEIAQIVLGPDAQKKLQQVPLSDDVIHSRIDEMSQDILQQVLEDIKASPLKVGIQLAETTDMDDCSQLMAFVRYIKEREIVEEFLFCEPLQLSMKGIDVFNLFRDFFLKHKIALDVCGSVCTDGASSMLGENSEFVAYVKKEIPHIVVTHCLLNPHALVIKTLPTKLRDALFTVVRVINFIKGRAPNHRLFQAFFEEIGIEYSVLLFHTEMRWLSRGQILTHIFEMYEEINQFLHHKSSNLVDGFENKEFKIHLAYLADLFKHLNELSASMQRTGMNTVSAREKLSAFVRKFPFWQKRIEKRNFTNFPFLEEIIVSDNEGIFIAAEITLHLQQLSNFFHGYFSIGDLNEASKWILDPFLFNIDFVDDSYLMKNDLAELRASGQILMEFETMKLEDFWCAQFTAFPNLAKTALEILMPFATTYLCELGFSSLLHFKTKSRSCFNLSDDIRVAISKKVPRFSDIIEQKLQLQQKSL

SEQ ID NO: 758140 - protein, 594 aa, Homo sapiens; identical to SEQ ID NO: 758139

SEQ ID NO: 758141 - protein, 594 aa, Homo sapiens; identical to SEQ ID NO: 758139

SEQ ID NO: 758142 - protein, 594 aa, Homo sapiens; identical to SEQ ID NO: 758139

SEQ ID NO: 758143 - protein, 1670 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTPGYPGIPGAAGLKGQKGAPAKGEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTLGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 758144 - protein, 1498 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTPGYPGIPGAAGLKGQKGAPAKGEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTLGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLDALFVKVLRSP

SEQ ID NO: 758145 - protein, 1498 aa, Homo sapiens; identical to SEQ ID NO: 758144

SEQ ID NO: 758146 - protein, 1445 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTPGYPGIPGAAGLKGQKGAPAKGEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTLGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGKPIPSTVKAGELEKIISRCQVCMKKRH

SEQ ID NO: 758147 - protein, 1642 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTPGYPGIPGAAGLKGQKGAPAKGEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTLGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMKAYSINCESWGIRKNNKSLSGVHEEKTLKLKKTCRTAIFHPKEQSNDRTCCYLGIFL

SEQ ID NO: 758148 - protein, 1494 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTPGYPGIPGAAGLKGQKGAPAKGEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTLGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLESLFHQL

SEQ ID NO: 758149 - protein, 98 aa, Homo sapiens
SGSQSLTQTLDARCLVQKQPAQPNRVTLLKPQMSNSPANRGCFCSFPLALPPGMKPDTDYPEDELSTLQWAQHAAASETIFSALTTLAGSSLWWGNWA

SEQ ID NO: 758150 - protein, 104 aa, Homo sapiens
QVKRVSPGEYRQRDSIASRTRSRSQRPNNTITYESERGGFRRTFSRSEWAGVRTYVSSTRIPICRILNTGLCETTSVAIQTMLRQIMTGFGELSYFMYSDSDSE

SEQ ID NO: 758151 - protein, 132 aa, Homo sapiens
VATRSRLPLFQPSSPSPILRPPRPIPEVLRPPRLSFCRVAQGFHPSARGMASTPMGNEGEKKSSWPSQAAPSLRGGPASLSRSEEYLSQISAELMEEALCTACCHLNPVPIKKKQSQDQATQISKRAFFTKT

SEQ ID NO: 758152 - protein, 132 aa, Homo sapiens; identical to SEQ ID NO: 758151

SEQ ID NO: 758153 - protein, 107 aa, Homo sapiens
KGELLEDLQGSLSLAPSSLTLWLTKSSCICLPSLDPRLLHSSRPLCSLRGSPSTRGLCLQTQGVLRTQLICLFSLRNEQYATHCLVLETAAPDILPSFLVLHGGCKL

SEQ ID NO: 758154 - protein, 107 aa, Homo sapiens
PEPFLTGRRYWKINSNLWLPSQQSLLQHIWEPEALKFDNSKDRTISQGVEATFHSAHLTLLGKETFGEDHYYSPNFIRDPIPSLLMSVCEILNYVMGVYVQKQYIFK

SEQ ID NO: 758155 - protein, 105 aa, Homo sapiens
MKITIFLSIPSWIQKCLFPECDTSQNPLESQPKGHIRMGQITFWKSCLGDSNSPPTQVRPTAQKWGSWVSMISHLSPHLSIQQRPSAGKRVWEEIEFTRLTCSLH

SEQ ID NO: 758156 - protein, 466 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 758157 - protein, 203 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKL

SEQ ID NO: 758158 - protein, 179 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTSAMDYTTHS

SEQ ID NO: 758159 - protein, 212 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNVPVTMEDTITVKINSSHRACQITSGRCAPALTSFPGAIVVTWHCLMLQKNLKSFRNWFRQ

SEQ ID NO: 758160 - protein, 359 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLMLFS

SEQ ID NO: 758161 - protein, 524 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKWVWSRGAAPLPGSGGKQEVGLGGQLGRAAAGRPHDPGARVWPPAATGVSLAHLMRRRRYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 758162 - protein, 255 aa, Homo sapiens
MPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 758163 - protein, 444 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKIQCGIQGDLKWSTDLLEFPALLSL

SEQ ID NO: 758164 - protein, 222 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNRK

SEQ ID NO: 758165 - protein, 191 aa, Homo sapiens
LAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPL

SEQ ID NO: 758166 - protein, 112 aa, Homo sapiens
RLKLKRLRVPPPRCCLGSASSPTLWQRRSSPRPPSHVQSRQERWGPVLARRGHRSGASVLPGVGETGAGPSLPAWGLGWALLICMGRKHMLVSTSFQASEYLSSPNVWVRLF

SEQ ID NO: 758167 - protein, 700 aa, Homo sapiens
PFLRRTAGRSDVLPVAGGEVRALQEGGCGDKMKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 758168 - protein, 723 aa, Homo sapiens
PFLRRTAGRSDVLPVAGGEVRALQEGGCGDKMKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKEEMEDFYPVLQFIFAPSSLTRKLDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 758169 - protein, 374 aa, Homo sapiens
GWGEAGTLIGRRGAVGVGNGPLGHGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 758170 - protein, 187 aa, Homo sapiens
PFLRRTAGRSDVLPVAGGEVRALQEGGCGDKMKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGMVPTGV

SEQ ID NO: 758171 - protein, 138 aa, Homo sapiens [sequence omitted]

SEQ ID NO: 758172 - protein, 138 aa, Homo sapiens [sequence omitted]

SEQ ID NO: 758173 - protein, 723 aa, Homo sapiens; identical to SEQ ID NO: 758168

SEQ ID NO: 758174 - protein, 672 aa, Homo sapiens
PFLRRTAGRSDVLPVAGGEVRALQEGGCGDKMKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKEEMEDFYPVLQFIFAPSSLTRKLDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYCMPPRLCPQLGLRARG

SEQ ID NO: 758175 - protein, 286 aa, Homo sapiens
GRSHFRLVTIAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 758176 - protein, 723 aa, Homo sapiens; identical to SEQ ID NO: 758168

SEQ ID NO: 758177 - protein, 723 aa, Homo sapiens; identical to SEQ ID NO: 758168

SEQ ID NO: 758178 - protein, 264 aa, Homo sapiens
RPALGSRQVVHNMTSEFFAAQLRAQISDDTTHPISYYKPEFYTPVDGGTAHLSVVAEDGSAVSATSTINLYFGSKVRSPVSEILFNDEMDDFSSPNITNEFGVPPSPANFIQPGKQPLSSMCPTIMVGQDGQVRMVVGAAGGTQITTATALICVTPFLPGRAHPAQPPSHADHTPMPQAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 758179 - protein, 211 aa, Homo sapiens
RPALGSRQVVHNMTSEFFAAQLRAQISDDTTHPISYYKPEFYTPVDGGTAHLSVVAEDGSAVSATSTINLYFGSKVRSPVSEILFNDEMDDFSSPNITNEFGVPPSPANFSSQPPSHADHTPMPQAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 758180 - protein, 174 aa, Homo sapiens
ITDCACESFNNLEKMTCLKEENCHITQSLRMGFLVCFSILSWPAAPAQALLTGVFLLQSVPQPVVCEQRRRHPGLPGSSRVQRAGGPVLPGLPRALHTPHPSGLGALFLGIPTVRRGGRGHRHRGQPVRRRSPRPPHSLMDTCVATFHVKQQGPGPERCSDFLSWQPVVTGLTY

SEQ ID NO: 758181 - protein, 436 aa, Homo sapiens [sequence omitted]

SEQ ID NO: 758182 - protein, 436 aa, Homo sapiens [sequence omitted]

SEQ ID NO: 758183 - protein, 372 aa, Homo sapiens
MSSPGTESAGKSLQYRVDHLLSAVENELQAGSEKGDPTERELRVGLEESDRSRRRPVAVYIHPDSPNFGAHWMKAPVSFSKVKLPNKLNGGAQIMLNSLHKYEPRIHIVRVGDPQRMITSHCFPETQFIAVTAYQNEEITALKIKYNPFAKAFLDAKERSDHKEMMEEPGDSQQPGYSQSGGWLLPGTSTLCPPANPHPQFGGALSLPSTHSCDRYPTLRSHRSSPYPSPYAHRNNSPTYSDNSPACLSMLQSHDNWSSLGMPAHPSMLPVSHNASPPTSSSQYPSLWSVSNGAVTPGSQAAAVSNGLGAQFFRGSPAHYTPLTHPVSAPSSSGSPLYEGAAAATDIVDSQYDAAAQGRLIASWTPVSPPSM

SEQ ID NO: 758184 - protein, 122 aa, Homo sapiens
MSSPGTESAGKSLQYRVDHLLSAVENELQAGSEKGDPTERELRVGLEESELWLRFKELTNEMIVTKNGRRMFPVLKVNVSGLHPSPIRSRRPLPRDPHCTKGRPRPQTSWTASTTPQPKAAS

SEQ ID NO: 758185 - protein, 98 aa, Homo sapiens
QRRVSSSSRGCPPAAPSLPTYYEEQLLPPAHKSQVHVTSSGSQPFPDPLRGSQRASLPDLTCSSFCMILEIAKHKRVNVKLRSETHPSLHSLYYALSQ

SEQ ID NO: 758186 - protein, 744 aa, Homo sapiens
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLASLRGEQGPRGEPGPRGPPGPPGLPGHGIPGIKGKPGPQGYPGVGKPGMPGMPGKPGAMGMPGAKGEIGQKGEIGPMGIPGPQGPPGPHGLPGIGKPGGPGLPGQPGPKGDRGPKGLPGPQGLRGPKGDKGFGMPGAPGVKGPPGMHGPPGPVGLPGVGKPGVTGFPGPQGPLGKPGAPGEPGPQGPIGVPGVQGPPGIPGIGKPGQDGIPGQPGFPGGKGEQGLPGLPGPPGLPGIGKPGFPGPKGDRGMGGVPGALGPRGEKGPIGAPGIGGPPGEPGLPGIPGPMGPPGAIGFPGPKGEGGIVGPQGPPGPKGEPGLQGFPGKPGFLGEVGPPGMRGLPGPIGPKGEAGQKGVPGLPGVPGLLGPKGEPGIPGDQGLQGPPGIPGIGGPSGPIGPPGIPGPKGEPGLPGPPGFPGIGKPGVAGLHGPPGKPGALGPQGQPGLPGPPGPPGPPGPPAVMPPTPPPQGEYLPDMGLGIDGVKPPHAYGAKKGKNGGPAYEMPAFTAELTAPFPPVGAPVKFNKLLYNGRQNYNPQTGIFTCEVPGVYYFAYHVHCKGGNVWVALFKNNEPVMYTYDEYKKGFLDQASGSAVLLLRPGDRVFLQMPSEQAAGLYAGQYVHSSFSGYLLYPM

SEQ ID NO: 758187 - protein, 744 aa, Homo sapiens; identical to SEQ ID NO: 758186

SEQ ID NO: 758188 - protein, 73 aa, Homo sapiens
QRRVSSSSRGCPPAAPSLPTYYEEQLLPPAHKSQVHVTSSGSQPFPDPLRGSQRASLPDLTCSRELTRSPTHP

SEQ ID NO: 758189 - protein, 744 aa, Homo sapiens; identical to SEQ ID NO: 758186

SEQ ID NO: 758190 - protein, 744 aa, Homo sapiens; identical to SEQ ID NO: 758186

SEQ ID NO: 758191 - protein, 101 aa, Homo sapiens
ARAPGEDACLRVVVLSAVIQQFVKLQLGGNVWVALFKNNEPVMYTYDEYKKGFLDQASGSAVLLLRPGDRVFLQMPSEQAAGLYAGQYVHSSFSGYLLYPM

SEQ ID NO: 758192 - protein, 736 aa, Homo sapiens [sequence omitted]

SEQ ID NO: 758193 - protein, 70 aa, Homo sapiens
EFGVQSPTRPGPFGAARERTKADGLGACAGHGGRAVSRDREAAGARARLGGGVFLFPQILVPTNKPAHVR

SEQ ID NO: 758194 - protein, 736 aa, Homo sapiens [sequence omitted]

SEQ ID NO: 758195 - protein, 110 aa, Homo sapiens
NRSVVIWLTVSRDRATALQPGPQSETPSQNKQTNYKPDHNTSVKKKNPRISHFFPRFYVICHSQDSACSCFADLAVLPTHQAHCRSFTFAVSSAWSIASRVFAGLCLLIL

SEQ ID NO: 758196 - protein, 480 aa, Homo sapiens
MNASEFRRRGKEMVDYVANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 758197 - protein, 480 aa, Homo sapiens; identical to SEQ ID NO: 758196

SEQ ID NO: 758198 - protein, 480 aa, Homo sapiens; identical to SEQ ID NO: 758196

SEQ ID NO: 758199 - protein, 480 aa, Homo sapiens; identical to SEQ ID NO: 758196

SEQ ID NO: 758200 - protein, 402 aa, Homo sapiens
MNASEFRRRGKEMVDYVANYMEGIEGRQVYPDVEPGYLRPLIPAAAPQEPDTFEDIINDVEKIIMPGGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 758201 - protein, 442 aa, Homo sapiens
MNASEFRRRGKEMVDYVANYMEGIEGRQVYPDVEPGYLRPLIPAAAPQEPDTFEDIINDVEKIIMPGAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 758202 - protein, 435 aa, Homo sapiens
MRGKEMVDYVANYMEGIEGRQVYPDVEPGYLRPLIPAAAPQEPDTFEDIINDVEKIIMPGAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 758203 - protein, 119 aa, Homo sapiens
MWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 758204 - protein, 106 aa, Homo sapiens
MRSSEYIYVVGMYGVCWKAWELYLVYWNWKLYISSISKLGIIFGLHYFPAEEGILALREGEYLAQHETVLKPSSPKSKTQLGSSHHILPPLHVTCTTWMWPVHIQA

SEQ ID NO: 758205 - protein, 735 aa, Homo sapiens
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 758206 - protein, 693 aa, Homo sapiens
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 758207 - protein, 434 aa, Homo sapiens
MPACSSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 758208 - protein, 160 aa, Homo sapiens [sequence omitted]

SEQ ID NO: 758209 - protein, 713 aa, Homo sapiens
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKVSLYGLRGLIWRREAGSHPRAFQQFMNSLISPSGCSTNPCCCISPSGRFPGRPPPPPHLVGVTW

SEQ ID NO: 758210 - protein, 192 aa, Homo sapiens
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPEK

SEQ ID NO: 758211 - protein, 761 aa, Homo sapiens
SPGLCLLLPWCRGPAGRMEQDPKPPRLRLWALIPWLPRKQRPRISQTSLPVPGPGSGPQRDSDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 758212 - protein, 735 aa, Homo sapiens; identical to SEQ ID NO: 758205

SEQ ID NO: 758213 - protein, 544 aa, Homo sapiens
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILMEDDGKPRAPQAPLHSVVQQLHGKNLVFSDGYVVKETIAGAL

SEQ ID NO: 758214 - protein, 67 aa, Homo sapiens
RARYPDVSADVTVDVPGSSMAQALLVESDSLYKLFFMKKMASTTMDFYKIHLPFWEQKQPLRPQEGN

SEQ ID NO: 758215 - protein, 69 aa, Homo sapiens
PWPSRGAGGPRDRTRCPRSPELRPVAVDPAPETPSRRSKTKTEPNTKLGEAVACRSQGDALCPGLPGSC

SEQ ID NO: 758216 - protein, 49 aa, Homo sapiens
TPPSISTPPSISTPPSISTPPSITGITCLPACFLFRSNPIITAVFKHCL

SEQ ID NO: 758217 - protein, 446 aa, Homo sapiens
ISLLRRCCCRHTRSPCLVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 758218 - protein, 489 aa, Homo sapiens
ISLLRRCCCRHTRSPCLALLLEIVSCFPLLFLNPLLFTPCFHLFGENPSRSPFPSSPASPVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 758219 - protein, 446 aa, Homo sapiens
DFPPSSLLLPPYALSLFSSSVRNSVFVFLCCSSIPYSSPLVFTYFAENPSRSPFPSSPASPSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 758220 - protein, 342 aa, Homo sapiens
MKMMRWRQQLGEMGLRPLPRRMSRAPMSPSTALAFVTSCSSQSCSGPLSTVALSIRQKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 758221 - protein, 321 aa, Homo sapiens
ISLLRRCCCRHTRSPCLALLLEIVSCFPLLFLNPLLFTPCFHLFGENPSRSPFPSSPASPVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDVNTLLPSLPPLPARC

SEQ ID NO: 758222 - protein, 158 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCE

SEQ ID NO: 758223 - protein, 190 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGKQGSVQAEGRAGGSSGPWRLRGALAALVRVSGIFQYETISCNNCTDSHVACFGYNCE

SEQ ID NO: 758224 - protein, 190 aa, Homo sapiens; identical to SEQ ID NO: 758223

SEQ ID NO: 758225 - protein, 179 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHK

SEQ ID NO: 758226 - protein, 184 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGKGRETEAGPPHPGTPRPPPEPDLLLPRRLRVFPQRAAKHLPGAGAPHPERHHRKPHRLSAPLWSSAQWKSAVQGLLNYINNWHK

SEQ ID NO: 758227 - protein, 233 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMRDHAPLPSPGLGHTEPPRPYLVSPALRCLEPPHLANLTLEDAAECLKQH

SEQ ID NO: 758228 - protein, 208 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMRPGIASLKVSGAPTLGQPDLGRCC

SEQ ID NO: 758229 - protein, 197 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYMPGIASLKVSGAPTLGQPDLGRCC

SEQ ID NO: 758230 - protein, 190 aa, Homo sapiens; identical to SEQ ID NO: 758223

SEQ ID NO: 758231 - protein, 209 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGKGRETEAGPPHPGTPRPRLSLTFSCLDDSGYFPNELRNIFREQVHLIQNAIIESRIDCQHRCGIFQYETISCNNCTDSHVACFGYNCESSAQWKSAVQGLLNYINNWHK

SEQ ID NO: 758232 - protein, 205 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMRDHAPLPSPGLGHTEPPRPCE

SEQ ID NO: 758233 - protein, 192 aa, Homo sapiens
NVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 758234 - protein, 1023 aa, Homo sapiens
NPVAKRHFVQSAKEVANSTANLVKTIKALDGDFSEDNRNKCRIATAPLIEAVENLTAFASNPEFVSIPAQISSEGSQAQEPILVSAKTMLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEIGFQIRTRVQDLGHGCIFLVQKAGALQVCPTDSYTKRELIECARAVTEKVSLVLSALQAGNKGTQACITAATAVSGIIADLDTTIMFATAGTLNAENSETFADHRENILKTAKALVEDTKLLVSGAASTPDKLAQAAQSSAATITQLAEVVKLGAASLGSDDPETQVVLINAIKDVAKALSDLISATKGAASKPVDDPSMYQLKGAAKVMVTNVTSLLKTVKAVEDEATRGTRALEATIECIKQELTVFQSKDVPEKTSSPEESIRMTKGITMATAKAVAAGNSCRQEDVIATANLSRKAVSDMLTACKQASFHPDVSDEVRTRALRFGTECTLGYLDLLEHVLVILQKPTPEFKQQLAAFSKRVAGAVTELIQAAEAMKGTEWVDPEDPTVIAETELLGAAASIEAAAKKLEQLKPRAKPKQADETLDFEEQILEAAKSIAAATSALVKSASAAQRELVAQGKVGSIPANAADDGQWSQGLISAARMVAAATSSLCEAANASVQGHASEEKLISSAKQVAASTAQLLVACKVKADQDSEAMRRLQAAGNAVKRASDNLVRAAQKAAFGKADDDDVVVKTKFVGGIAQIIAAQEEMLKKERELEEARKKLAQIRQQQYKFLPTELREDEG

SEQ ID NO: 758235 - protein, 221 aa, Homo sapiens
PRAESARGGTRPKQADETLDFEEQILEAAKSIAAATSALVKSASAAQRELVAQGKVGSIPANAADDGQWSQGLISAARMVAAATSSLCEAANASVQGHASEEKLISSAKQVAASTAQLLVACKVKADQDSEAMRRLQAAGNAVKRASDNLVRAAQKAAFGKADDDDVVVKTKFVGGIAQIIAAQEEMLKKERELEEARKKLAQIRQQQYKFLPTELREDEG

SEQ ID NO: 758236 - protein, 1013 aa, Homo sapiens
VYHRHPIQLSLIEFDLAALDGDFSEDNRNKCRIATAPLIEAVENLTAFASNPEFVSIPAQISSEGSQAQEPILVSAKTMLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEIGFQIRTRVQDLGHGCIFLVQKAGALQVCPTDSYTKRELIECARAVTEKVSLVLSALQAGNKGTQACITAATAVSGIIADLDTTIMFATAGTLNAENSETFADHRENILKTAKALVEDTKLLVSGAASTPDKLAQAAQSSAATITQLAEVVKLGAASLGSDDPETQVVLINAIKDVAKALSDLISATKGAASKPVDDPSMYQLKGAAKVMVTNVTSLLKTVKAVEDEATRGTRALEATIECIKQELTVFQSKDVPEKTSSPEESIRMTKGITMATAKAVAAGNSCRQEDVIATANLSRKAVSDMLTACKQASFHPDVSDEVRTRALRFGTECTLGYLDLLEHVLVILQKPTPEFKQQLAAFSKRVAGAVTELIQAAEAMKGTEWVDPEDPTVIAETELLGAAASIEAAAKKLEQLKPRAKPKQADETLDFEEQILEAAKSIAAATSALVKSASAAQRELVAQGKVGSIPANAADDGQWSQGLISAARMVAAATSSLCEAANASVQGHASEEKLISSAKQVAASTAQLLVACKVKADQDSEAMRRLQAAGNAVKRASDNLVRAAQKAAFGKADDDDVVVKTKFVGGIAQIIAAQEEMLKKERELEEARKKLAQIRQQQYKFLPTELREDEG

SEQ ID NO: 758237 - protein, 1013 aa, Homo sapiens; identical to SEQ ID NO: 758236

SEQ ID NO: 758238 - protein, 408 aa, Homo sapiens
VYHRHPIQLSLIEFDLAALDGDFSEDNRNKCRIATAPLIEAVENLTAFASNPEFVSIPAQISSEGSQAQEPILVSAKTMLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEVCHLKTPILRCTHTLVPTPGYFFIA

SEQ ID NO: 758239 - protein, 1013 aa, Homo sapiens; identical to SEQ ID NO: 758236

SEQ ID NO: 758240 - protein, 155 aa, Homo sapiens
LSLSCSFWLPPPGMSSVTVAGDVALEKAASCWLNSGVGFCRITKTCSRRSKLLVACKVKADQDSEAMRRLQAAGNAVKRASDNLVRAAQKAAFGKADDDDVVVKTKFVGGIAQIIAAQEEMLKKERELEEARKKLAQIRQQQYKFLPTELREDEG

SEQ ID NO: 758241 - protein, 1013 aa, Homo sapiens; identical to SEQ ID NO: 758236

SEQ ID NO: 758242 - protein, 1062 aa, Homo sapiens
VYHRHPIQLSLIEFDLAALDGDFSEDNRNKCRIATAPLIEAVENLTAFASNPEFVSIPAQISSEGSQAQEPILVSAKTMLESSSYLIRTARSLAINPKDPPTWSVLAGHSHTVSDSIKSLITSIRDKAPGQRECDYSIDGINRCIRDIEQASLAAVSQSLATRDDISVEALQEQLTSVVQEIGHLIDPIATAARGEAAQLGHKVTQLASYFEPLILAAVGVASKILDHQQQMTVLDQTKTLAESALQMLYAAKEGGGNPKAQHTHDAITEAAQLMKEAVDDIMVTLNEAASEVGLVGGMVDAIAEAMSKLDEGTPPEPKGTFVDYQTTVVKYSKAIAVTAQEMMTKSVTNPEELGGLASQMTSDYGHLAFQGQMAAATAEPEEIGFQIRTRVQDLGHGCIFLVQKAGALQVCPTDSYTKRELIECARAVTEKVSLVLSALQAGNKGTQACITAATAVSGIIADLDTTIMFATAGTLNAENSETFADHRENILKTAKALVEDTKLLVSGAASTPDKLAQAAQSSAATITQLAEVVKLGAASLGSDDPETQVVLINAIKDVAKALSDLISATKGAASKPVDDPSMYQLKGAAKVMVTNVTSLLKTVKAVEDEATRGTRALEATIECIKQELTVFQSKDVPEKTSSPEESIRMTKGITMATAKAVAAGNSCRQEDVIATANLSRKAVSDMLTACKQASFHPDVSDEVRTRALRFGTECTLGYLDLLEHVLVILQKPTPEFKQQLAAFSKRVAGAVTELIQAAEAMKGTEWVDPEDPTVIAETELLGAAASIEAAAKKLEQLKPRAKPKQADETLDFEEQILEAAKSIAAATSALVKSASAAQRELVAQGKVGSIPANAADDGQWSQGLISAARMVAAATSSLCEAANASVQGHASEEKLISSAKQVAASTAQLLVACKVKADQDSEAMRRLQAAGNAVKRASDNLVRAAQKAAFGKADDDDVVVKTKFVGGIAQIIAAQEEMLKKERELEEARKKLAQIRQQQYKFLPHPGGEKFPPLFARFLASVCKLLVQPRPILYFVAQKTERLFCSSVVQRAELRKAVGAW

SEQ ID NO: 758243 - protein, 159 aa, Homo sapiens
MQRVGNTFSNESRVASRCPSVGLAERNRVATMPVRLLRDSPAAQEDNDHARDGFQMKLDAHGFAPEELVVQVDGQWLMVTGQQQLDVRDPERVSYRMSQKVHRKMLPSNLSPTAMTCCLTPSGQLWVRGQCVALALPEAQTGPSPRLGSLGSKASNLTR

SEQ ID NO: 758244 - protein, 822 aa, Homo sapiens
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSLPPPLQLIPEVQKPLHEQLWYHGAIPRAEVAELLVHSGDFLVRESQGKQEYVLSVLWDGLPRHFIIQSLDNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 758245 - protein, 822 aa, Homo sapiens; identical to SEQ ID NO: 758244

SEQ ID NO: 758246 - protein, 89 aa, Homo sapiens
GGLSAPGPGQALSPLLLSLSPSQGSRPLRMEAADPGSPALQNLYRLEGEGFPSIPLLIDHLLSTQQPLTKKSGVVLHRAVPKVSLHPAW

SEQ ID NO: 758247 - protein, 65 aa, Homo sapiens
MSPCPVSPRDLAARNCLVTEKNVLKISDFGMSREEADGVYAASGGLRCGPLHGDLSEATLMLGYR

SEQ ID NO: 758248 - protein, 778 aa, Homo sapiens
TRGVQEQLPVRNSTMGFSSELCSPQGHGVLQQMQEAELRLLEGMRKWMAQRVKSDREYAGLLHHMSLQDSGGQSRAISPDSPISQTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSLPPPLQLIPEVQKPLHEQLWYHGAIPRAEVAELLVHSGDFLVRESQGKQEYVLSVLWDGLPRHFIIQSLDNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 758249 - protein, 107 aa, Homo sapiens [sequence omitted]

SEQ ID NO: 758250 - protein, 106 aa, Homo sapiens [sequence omitted]

SEQ ID NO: 758251 - protein, 494 aa, Homo sapiens
MARAAPLLAALTALLAAAAAGGDAPPGKIAVVGAGIGGSAVAHFLQQHFGPRVQIDVYEKGTVGGRLATISVNKQHYESGAASFHSLSLHMQDFVKLLGLRHRREVVGRSAIFGGEHFMLEETDWYLLNLFRLWWHYGISFLRLQMWVEEVMEKFMRIYKYQAHGYAFSGVEELLYSLGESTFVNMTQHSVAESLLQVGVTQRFIDDVVSAVLRASYGQSAAMPAFAGAMSLAGAQGSLWSVEGGNKLVCSGLLKLTKANVIHATVTSVTLHSTEGKALYQVAYENEVGNSSDFYDIVVIATPLHLDNSSSNLTFAGFHPPIDDVQGSFQPTVVSLVHGYLNSSYFGFPDPKLFPFANILTTDFPSFFCTLDNICPVNISASFRRKQPQEAAVWRVQSPKPLFRTQLKTLFRSYYSVQTAEWQAHPLYGSRPTLPRFALHDQLFYLNALEWAASSVEVMAVAAKNVALLAYNRWYQDLDKIDQKDLMHKVKTEL

SEQ ID NO: 758252 - protein, 494 aa, Homo sapiens; identical to SEQ ID NO: 758251

SEQ ID NO: 758253 - protein, 435 aa, Homo sapiens
MARAAPLLAALTALLAAAAAGGDAPPGKIAVVGAGIGGSAVAHFLQQHFGPRVQIDVYEKGTVGGRLATISVNKQHYESGAASFHSLSLHMQDFVKLLGLRHRREVVGRSAIFGGEHFMLEETDWYLLNLFRLWWHYGISFLRLQMWVEEVMEKFMSYGQSAAMPAFAGAMSLAGAQGSLWSVEGGNKLVCSGLLKLTKANVIHATVTSVTLHSTEGKALYQVAYENEVGNSSDFYDIVVIATPLHLDNSSSNLTFAGFHPPIDDVQGSFQPTVVSLVHGYLNSSYFGFPDPKLFPFANILTTDFPSFFCTLDNICPVNISASFRRKQPQEAAVWRVQSPKPLFRTQLKTLFRSYYSVQTAEWQAHPLYGSRPTLPRFALHDQLFYLNALEWAASSVEVMAVAAKNVALLAYNRWYQDLDKIDQKDLMHKVKTEL

SEQ ID NO: 758254 - protein, 309 aa, Homo sapiens [sequence omitted]

SEQ ID NO: 758255 - protein, 114 aa, Homo sapiens
MKSLRPCLLPREPECPQMLVLPLHPLLQTPQWLHPKPLNFASLSPNPQFHPTSKTALPPIPISAEGTIIHPVATSRNVCITWALRMTSALLSQQNVGSVLKVSSDKEIFKALLP

SEQ ID NO: 758256 - protein, 114 aa, Homo sapiens; identical to SEQ ID NO: 758255

SEQ ID NO: 758257 - protein, 128 aa, Homo sapiens
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLSIHIHTENTGVKRRIFCTN

SEQ ID NO: 758258 - protein, 153 aa, Homo sapiens
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 758259 - protein, 112 aa, Homo sapiens
SQPSYLVWTLTNLIHNMGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 758260 - protein, 153 aa, Homo sapiens; identical to SEQ ID NO: 758258

SEQ ID NO: 758261 - protein, 153 aa, Homo sapiens; identical to SEQ ID NO: 758258

SEQ ID NO: 758262 - protein, 153 aa, Homo sapiens; identical to SEQ ID NO: 758258

SEQ ID NO: 758263 - protein, 153 aa, Homo sapiens; identical to SEQ ID NO: 758258

SEQ ID NO: 758264 - protein, 153 aa, Homo sapiens; identical to SEQ ID NO: 758258

SEQ ID NO: 758265 - protein, 207 aa, Homo sapiens
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLARPGARADVGTVHVGVKRNTRVMNSRGIWLSYGCWPSVSSHIVLLSIPFVSVPVVWTLTNLIHNMGMYIFLHTVTVDTLETRTGKGGVTMGARYGPVR

SEQ ID NO: 758266 - protein, 88 aa, Homo sapiens
TAERGSRMNVGTAHSEVNPNTRVMNSRGIWLSYVLAIGLLHIVLLSIPFVSVPVVWTLTNLIHNMVRACLLPAPAPAPCGLPFGRAEG

SEQ ID NO: 758267 - protein, 188 aa, Homo sapiens
MNGDDTFAKRPRDDAKASEKRSKAFDDIATYFSKKEWKKMKYSEKISYVYMKRNYKAMTKLGFKVTLPPFMCNKQATDFQGNDFDNDHNRRIQVEHPQMTFGRLHRIIPKIMPKKPAEDENDSKGVSEASGPQNDGKQLHPPGKANISEKINKRSGPKRGKHAWTHRLRERKQLVIYEEISDPEEDDE

SEQ ID NO: 758268 - protein, 158 aa, Homo sapiens
QQQDAYQGPPPQQGYPPQQQQYPGQQGYPGQQQGYGPSQGGPGPQYPNYPQGQGQQYGGYRPTQPGPPQPPQQRPYGYDQIMPKKPAEDENDSKGVSEASGPQNDGKQLHPPGKANISEKINKRSGPKRGKHAWTHRLRERKQLVIYEEISDPEEDDE

SEQ ID NO: 758269 - protein, 188 aa, Homo sapiens; identical to SEQ ID NO: 758267

SEQ ID NO: 758270 - protein, 188 aa, Homo sapiens; identical to SEQ ID NO: 758267

SEQ ID NO: 758271 - protein, 188 aa, Homo sapiens; identical to SEQ ID NO: 758267

SEQ ID NO: 758272 - protein, 351 aa, Homo sapiens
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPLRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 758273 - protein, 351 aa, Homo sapiens; identical to SEQ ID NO: 758272

SEQ ID NO: 758274 - protein, 351 aa, Homo sapiens; identical to SEQ ID NO: 758272

SEQ ID NO: 758275 - protein, 138 aa, Homo sapiens
VLVAWLASSLLLLQDPPGQRRPSREIHTILCAGFGPNASWAFLALGDQCMSWDCLTLRIAGTPRSLGPLWLWGAQAPCFFLLCYSEGSSGSQDTVIVLHLQPQSRQGQATHLHRESKTQQLWSTSACSLLARGRSRDH

SEQ ID NO: 758276 - protein, 143 aa, Homo sapiens
NEHLQALLTPDEPDKSQGQDLQEQLAEGCRLAQHLVQKLSPENDEDEDEDVQVEEDEKVLESSSPREMQKAEESKVPEDSLEECAITCSNSHGPCDSNQPHKNIKITFEEDKVNSSLVVDREYSHDECQDALNILPGSLYFPC

SEQ ID NO: 758277 - protein, 381 aa, Homo sapiens [sequence omitted]

SEQ ID NO: 758278 - protein, 111 aa, Homo sapiens
MWVFSEEGYKKYNINEFMFLAKKNQEILWILHTHSFTFFTSTWEVIRSAAVKLTDAVVLNLTSQYVELLDREQLTTRLQALRQDPCISVQRAAEAALQTLLRRCKETSIPL

SEQ ID NO: 758279 - protein, 448 aa, Homo sapiens
SPQVACAMYEVISMGTSVTGLYPELFTLLLKLVSCTLGQKMLTCPWSHRRHVMQQGEQQQIPDPCRLSTATLKCLQAQAMREGLAKESDEGDNLWTLLSSPSTHHIGVCSLARSMAVWQHGVILDIMEQLLSSLTSSSENYRITGAAFFSELMKEPILWKHGNLRNVLILMDQSAWDSNATLRQMAIRGLGNTASGAPHKVKKHKQLMLESIIRGLYHLARTEVVCESLKALKKILELLTDRDVSFYFKEIVLQTRTFFEDEQDDVRLTAIFLFEDLAPLTGRRWKIFFAEEIKKSLISFLLHLWDPNPKIGVACRDVLMVCIPFLGLQELYGVLDRLLDQDLPRARDFYRQFCVKLAKKNQEILWILHTHSFTFFTSTWEVIRSAAVKLTDAVVLNLTSQYVELLDREQLTTRLQALRQDPCISVQRAAEAALQTLLRRCKETSIPL

SEQ ID NO: 758280 - protein, 444 aa, Homo sapiens
SPQVACAMYEVISMGTSVTGLYPELFTLLLKLVSCTLGQKMLTCPWSHRRHVMQQGEQQQIPDPCRLSTATLKCLQAQAMREGLAKESDEGDNLWTLLSSPSTHHIGVCSLARSMAVWQHGVILDIMEQLLSSLTSSSENYRITGAAFFSELMKEPILWKHGNLRNVLILMDQSAWDSNATLRQMAIRGLGNTASGAPHKVKKHKQLMLESIIRGLYHLARTEVVCESLKALKKILELLTDRDVSFYFKEIVLQTRTFFEDEQDDVRLTAIFLFEDLAPLTGRRWKIFFAEEIKKSLISFLLHLWDPNPKIGVACRDVLMVCIPFLGLQELYGVLDRLLDQDLPRARDFYRQFCVKLAKKNQEILWILHTHSFTFFTSTWEVIRSAAVKLTDAVVLNLTSQYVELLDREQLTTHTRISPGYKAISSSSPLQASETPIDYDFPIA

SEQ ID NO: 758281 - protein, 187 aa, Homo sapiens
HRARVEIRLFSLNGSCITHFLLKRRIFFAEEIKKSLISFLLHLWDPNPKIGVACRDVLMVCIPFLGLQELYGVLDRLLDQDLPRARDFYRQFCVKLAKKNQEILWILHTHSFTFFTSTWEVIRSAAVKLTDAVVLNLTSQYVELLDREQLTTRLQALRQDPCISVQRAAEAALQTLLRRCKETSIPL

SEQ ID NO: 758282 - protein, 1233 aa, Homo sapiens
KEQDLKTNKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKQEQDKMNDELYKEEKIWKEKFKQHEEYIRNLHLQMEEERTRFKDQQEKEKNSLLKQQNNAAVKIQAKYKAFVAYQKYGPIIKEQIESKKRKAQEWKEKEAKIRQKEEENRKRLEEEQRIKEERKKQKEEERKRREKEYEEKKNIVKQEREQLISKEKIILREDASQQLIISSALKKSGYNNKHLSLEDISNDKGDIAKNLVDENSKKQEDVLLWLVEESNMKENVDRQTILKESIQVKLKESISSQTILADFKMEEKNENLAKKRCSEELVKQERKYENTDNKTELGNSDLKGNLKEQFPLQELKSDAQKEEKIMKHVINENTGQKTQIILGHNQEISEVKTNEEQKIIKDNQQKKIQKVEKEEIQEQNGLLYKDKDTLVISVKQRSLSLTSENSKDVRENVILQEKEIYSKSKEIEENPKDNAWNSGIVIFNTTDTMINIEGKRNDQDYVLGRHAPCEGLSNYNAESSMVSKEVNSLKSEIRNISEKCHENAPEPDSMTCCVSESTLLYSIEERRLAWIKSFKPWLEIFKQNQQKKIVRRKRPVKCPANMTPALDKLEILRCGPWDTLQQVTTVTFQDLPGCVLSTLAECTNLQFLSLRRCGLTSLHSLSNCKKLKYIDAQENHIEAIECENLENLCVVLLNKNQLTSLHGLDGCTNIQCLELSYNKITRIGYSFFLEEKLVDNAGFCHHLGTSTSYLSLAQVWIPTGLCWSWIPITSLTKNSDCNFLISHLYWNCGLESLKNLQQLILDHNQLINTKGLCDTPTIVYLDCSHNHLTDVEGVENCGLLQILKLQGNYLSELPSLENLVLLRELHLDDNSISTVEAFSSYWLPLLQNITISQNSLTKIVPLFHFVSLEKLDVSHNCLSDLKSAIKWFDACYSLHELSLTGNPLLQETNWRDSLLKVLPALRILNGNILNSNSESRTEEHNQLGSAGFLALCQSQIREFNLLIENYITGKGDVFTLDTAENLCHYFKKLMILSTEYRHAHERGDVTITKKDESEAQKNHLAPTNSDSTLQNGVFYSCAREGEPDSPDIPEKWMDSVSSHSPLSKSATCENMEGRHQEILVCQKREDSKASSIPTIRIPFKEVVMTNSLLRNHQNIEPSEKM

SEQ ID NO: 758283 - protein, 242 aa, Homo sapiens
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKVFCFCFSCIFKISSYL

SEQ ID NO: 758284 - protein, 1336 aa, Homo sapiens
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKQEQDKMNDELYKEEKIWKEKFKQHEEYIRNLHLQMEEERTRFKDQQEKEKNSLLKQQNNAAVKIQAKYKAFVAYQKYGPIIKEQIESKKRKAQEWKEKEAKIRQKEEENRKRLEEEQRIKEERKKQKEEERKRREKEYEEKKNIVKQEREQLISKEKIILREDASQQLIISSALKKSGYNNKHLSLEDISNDKGDIAKNLVDENSKKQEDVLLWLVEESNMKENVDRQTILKESIQVKLKESISSQTILADFKMEEKNENLAKKRCSEELVKQERKYENTDNKTELGNSDLKGNLKEQFPLQELKSDAQKEEKIMKHVINENTGQKTQIILGHNQEISEVKTNEEQKIIKDNQQKKIQKVEKEEIQEQNGLLYKDKDTLVISVKQRSLSLTSENSKDVRENVILQEKEIYSKSKEIEENPKDNAWNSGIVIFNTTDTMINIEGKRNDQDYVLGRHAPCEGLSNYNAESSMVSKEVNSLKSEIRNISEKCHENAPEPDSMTCCVSESTLLYSIEERRLAWIKSFKPWLEIFKQNQQKKIVRRKRPVKCPANMTPALDKLEILRCGPWDTLQQVTTVTFQDLPGCVLSTLAECTNLQFLSLRRCGLTSLHSLSNCKKLKYIDAQENHIEAIECENLENLCVVLLNKNQLTSLHGLDGCTNIQCLELSYNKITRIGYSFFLEEKLVDNAGFCHHLGTSTSYLSLAQVWIPTGLCWSWIPITSLTKNSDCNFLISHLYWNCGLESLKNLQQLILDHNQLINTKGLCDTPTIVYLDCSHNHLTDVEGVENCGLLQILKLQGNYLSELPSLENLVLLRELHLDDNSISTVEAFSSYWLPLLQNITISQNSLTKIVPLFHFVSLEKLDVSHNCLSDLKSAIKWFDACYSLHELSLTGNPLLQETNWRDSLLKVLPALRILNGNILNSNSESRTEEHNQLGSAGFLALCQSQIREFNLLIENYITGKGDVFTLDTAENLCHYFKKLMILSTEYRHAHERGDVTITKKDESEAQKNHLAPTNSDSTLQNGVFYSCAREGEPDSPDIPEKWMDSVSSHSPLSKSATCENMEGRHQEILVCQKREDSKASSIPTIRIPFKEVVMTNSLLRNHQNIEPSEKM

SEQ ID NO: 758285 - protein, 1537 aa, Homo sapiens
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKQEQDKMNDELYKEEKIWKEKFKQHEEYIRNLHLQMEEERTRFKDQQEKEKNSLLKQQNNAAVKIQAKYKAFVAYQKYGPIIKEQIESKKRKAQEWKEKEAKIRQKEEENRKRLEEEQRIKEERKKQKEEERKRREKEYEEKKNIVKQEREQLISKEKIILREDASQQLIISSALKKSGYNNKHLSLEDISNDKGDIAKNLVDENSKKQEDVLLWLVEESNMKENVDRQTILKESIQVKLKESISSQTILADFKMEEKNENLAKKRCSEELVKQERKYENTDNKTELGNSDLKGNLKEQFPLQELKSDAQKEEKIMKHVINENTGQKTQIILGHNQEISEVKTNEEQKIIKDNQQKKIQKVEKEEIQEQNGLLYKDKDTLVISVKQRSLSLTSENSKDVRENVILQEKEIYSKSKEIEENPKDNAWNSGIVIFNTTDTMINIEGKRNDQDYVLGRHAPCEGLSNYNAESSMVSKEVNSLKSEIRNISEKCHENAPEPDSMTCCVSESTLLYSIEERRLAWIKSFKPWLEIFKQNQQKKIVRRKRPVKCPANMTPALDKLEILRCGPWDTLQQVTTVTFQDLPGCVLSTLAECTNLQFLSLRRCGLTSLHSLSNCKKLKYIDAQENHIEAIECENLENLCVVLLNKNQLTSLHGLDGCTNIQCLELSYNKITRIGYSFFLEEKLVDNAGFCHHLGTSTSYLSLAQVWIPTGLCWSWIPITSLTKNSDCNFLISHLYWNCGLESLKNLQQLILDHNQLINTKGLCDTPTIVYLDCSHNHLTDVEGVENCGLLQILKLQGNYLSELPSLENLVLLRELHLDDNSISTVEAFSSYWLPLLQNITISQNSLTKIVPLFHFVSLEKLDVSHNCLSDLKSAIKWFDACYSLHELSLTGNPLLQETNWRDSLLKVLPALRILNGNILNSNSESRTEEHNQLGSAGFLALCQSQIREFNLLIENYITGKGDVFTLDTAENLCHYFKKLMILSTEYRHAHERGDVTITKKDESEAQKNHLAPTNSDSTLQNGVFYSCAREGEPDSPDIPEKWMDSVSSHSPLSKSATCENMEGRHQEILVCQKREDSKASSIPTIRIPFKEVVMTNSLLRNHQNIEPSEKIMAAVVIQSYWRGYLMRRQTHFSTRLHTAATEGLPNSSIKNQTILKKGKRENIVNIRKQREKAAILIQAVWKGFILRKKLTTALEAIKNEESDEEYREIDLEDFIFDEAALEEEWLALDSTRFPSQTLLLSNQLHWPKIPGNLKWDDTSFNLPSNPAQAWLCNDKENLSSSEHTQFNSRSENKTSSWTPESKTSRKSLLKSE

SEQ ID NO: 758286 - protein, 1311 aa, Homo sapiens
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKEYIRNLHLQMEEERTRFKDQQEKEKNSLLKQQNNAAVKIQAKYKAFVAYQKYGPIIKEQIESKKRKAQEWKEKEAKIRQKEEENRKRLEEEQRIKEERKKQKEEERKRREKEYEEKKNIVKQEREQLISKEKIILREDASQQLIISSALKKSGYNNKHLSLEDISNDKGDIAKNLVDENSKKQEDVLLWLVEESNMKENVDRQTILKESIQVKLKESISSQTILADFKMEEKNENLAKKRCSEELVKQERKYENTDNKTELGNSDLKGNLKEQFPLQELKSDAQKEEKIMKHVINENTGQKTQIILGHNQEISEVKTNEEQKIIKDNQQKKIQKVEKEEIQEQNGLLYKDKDTLVISVKQRSLSLTSENSKDVRENVILQEKEIYSKSKEIEENPKDNAWNSGIVIFNTTDTMINIEGKRNDQDYVLGRHAPCEGLSNYNAESSMVSKEVNSLKSEIRNISEKCHENAPEPDSMTCCVSESTLLYSIEERRLAWIKSFKPWLEIFKQNQQKKIVRRKRPVKCPANMTPALDKLEILRCGPWDTLQQVTTVTFQDLPGCVLSTLAECTNLQFLSLRRCGLTSLHSLSNCKKLKYIDAQENHIEAIECENLENLCVVLLNKNQLTSLHGLDGCTNIQCLELSYNKITRIGYSFFLEEKLVDNAGFCHHLGTSTSYLSLAQVWIPTGLCWSWIPITSLTKNSDCNFLISHLYWNCGLESLKNLQQLILDHNQLINTKGLCDTPTIVYLDCSHNHLTDVEGVENCGLLQILKLQGNYLSELPSLENLVLLRELHLDDNSISTVEAFSSYWLPLLQNITISQNSLTKIVPLFHFVSLEKLDVSHNCLSDLKSAIKWFDACYSLHELSLTGNPLLQETNWRDSLLKVLPALRILNGNILNSNSESRTEEHNQLGSAGFLALCQSQIREFNLLIENYITGKGDVFTLDTAENLCHYFKKLMILSTEYRHAHERGDVTITKKDESEAQKNHLAPTNSDSTLQNGVFYSCAREGEPDSPDIPEKWMDSVSSHSPLSKSATCENMEGRHQEILVCQKREDSKASSIPTIRIPFKEVVMTNSLLRNHQNIEPSEKM

SEQ ID NO: 758287 - protein, 1155 aa, Homo sapiens
LSELPSLENLVLLRELHLDDNSISTVEAFSSYWLPLLQNITISQNSLTKIVPLFHFVSLEKQMSATIVFLEYIRNLHLQMEEERTRFKDQQEKEKNSLLKQQNNAAVKIQAKYKAFVAYQKYGPIIKEQIESKKRKAQEWKEKEAKIRQKEEENRKRLEEEQRIKEERKKQKEEERKRREKEYEEKKNIVKQEREQLISKEKIILREDASQQLIISSALKKSGYNNKHLSLEDISNDKGDIAKNLVDENSKKQEDVLLWLVEESNMKENVDRQTILKESIQVKLKESISSQTILADFKMEEKNENLAKKRCSEELVKQERKYENTDNKTELGNSDLKGNLKEQFPLQELKSDAQKEEKIMKHVINENTGQKTQIILGHNQEISEVKTNEEQKIIKDNQQKKIQKVEKEEIQEQNGLLYKDKDTLVISVKQRSLSLTSENSKDVRENVILQEKEIYSKSKEIEENPKDNAWNSGIVIFNTTDTMINIEGKRNDQDYVLGRHAPCEGLSNYNAESSMVSKEVNSLKSEIRNISEKCHENAPEPDSMTCCVSESTLLYSIEERRLAWIKSFKPWLEIFKQNQQKKIVRRKRPVKCPANMTPALDKLEILRCGPWDTLQQVTTVTFQDLPGCVLSTLAECTNLQFLSLRRCGLTSLHSLSNCKKLKYIDAQENHIEAIECENLENLCVVLLNKNQLTSLHGLDGCTNIQCLELSYNKITRIGYSFFLEEKLVDNAGFCHHLGTSTSYLSLAQVWIPTGLCWSWIPITSLTKNSDCNFLISHLYWNCGLESLKNLQQLILDHNQLINTKGLCDTPTIVYLDCSHNHLTDVEGVENCGLLQILKLQGNYLSELPSLENLVLLRELHLDDNSISTVEAFSSYWLPLLQNITISQNSLTKIVPLFHFVSLEKLDVSHNCLSDLKSAIKWFDACYSLHELSLTGNPLLQETNWRDSLLKVLPALRILNGNILNSNSESRTEEHNQLGSAGFLALCQSQIREFNLLIENYITGKGDVFTLDTAENLCHYFKKLMILSTEYRHAHERGDVTITKKDESEAQKNHLAPTNSDSTLQNGVFYSCAREGEPDSPDIPEKWMDSVSSHSPLSKSATCENMEGRHQEILVCQKREDSKASSIPTIRIPFKEVVMTNSLLRNHQNIEPSEKM

SEQ ID NO: 758288 - protein, 186 aa, Homo sapiens
HLGARVFVTGTHGQTVVFRDRTDFGGGGEANKPRNVRNKSRMKYSDLCISFFFFFFVKFDFNSCFFLMVWCLFFPPPLAAELRCFVVLFFFFFFFIFFLNSEARPSFLTAPRLHLRGHASFPWLPELLLPSPAWASPWCTRSRNRASAPCERRTCWRSSGRGLLPRSWARGLGGQGEAAEDLGWDG

SEQ ID NO: 758289 - protein, 111 aa, Homo sapiens
MSLKSATKWGRRCNYYYQHLESIMNLLEYFLALTSFILRCSYWIFPSANNMEVPIQGQIIPGFIWSCLKVKSLEFLMIPFLYGLQFDRWEFSTLKKYPQVTTDVLTPSMFR

SEQ ID NO: 758290 - protein, 120 aa, Homo sapiens
RHSVESSGKLVGGHTSKLRSIICNLTIFSRPNLMHIFMQPLSETAFKKEDTLKKWLKWFFFFFFGDRISKSWSLTLLPLSPVVPATQEAETGESLELGGGCSELVIVPLHFSQGNKARPL

SEQ ID NO: 758291 - protein, 111 aa, Homo sapiens; identical to SEQ ID NO: 758289

SEQ ID NO: 758292 - protein, 186 aa, Homo sapiens; identical to SEQ ID NO: 758288

SEQ ID NO: 758293 - protein, 186 aa, Homo sapiens; identical to SEQ ID NO: 758288

SEQ ID NO: 758294 - protein, 111 aa, Homo sapiens; identical to SEQ ID NO: 758289

SEQ ID NO: 758295 - protein, 111 aa, Homo sapiens; identical to SEQ ID NO: 758289

SEQ ID NO: 758296 - protein, 111 aa, Homo sapiens; identical to SEQ ID NO: 758289

SEQ ID NO: 758297 - protein, 111 aa, Homo sapiens; identical to SEQ ID NO: 758289

SEQ ID NO: 758298 - protein, 111 aa, Homo sapiens; identical to SEQ ID NO: 758289

SEQ ID NO: 758299 - protein, 158 aa, Homo sapiens
MSLKSATKWGRRCNYYYQHLESIMNLLEYFLALTSFILRCSYWIFPSANNMEVPIQGQIIPGFIWSCLKVKSLEFLMIPFLYGLQFDRWEFSTLKKTLLLSGNPCPPLTSTQNCFPHSLTARVVKNWDVLLRWAVECHTESRSLGVSLCCHEYEVAVN

SEQ ID NO: 758300 - protein, 430 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 758301 - protein, 550 aa, Homo sapiens
GYQLHGAEVNGGLPSASSFSSAPGATYGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 758302 - protein, 320 aa, Homo sapiens
MLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 758303 - protein, 37 aa, Homo sapiens
MPKILPTDPKAALGTFYCFKKVSEKAELSSFEQHSMP

SEQ ID NO: 758304 - protein, 86 aa, Homo sapiens
YEAWCDSDEGLTGLLEFAETRRRREPVLCLPLRLGEIWLLQQPTPFEITLARSGGGGQRGVGGESLHCNPPAFLSFLPINAYLQKD

SEQ ID NO: 758305 - protein, 430 aa, Homo sapiens; identical to SEQ ID NO: 758300

SEQ ID NO: 758306 - protein, 347 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGGYPSPCYQPDRRIQ

SEQ ID NO: 758307 - protein, 320 aa, Homo sapiens; identical to SEQ ID NO: 758302

SEQ ID NO: 758308 - protein, 333 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAG

SEQ ID NO: 758309 - protein, 343 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGIPFCRLLTVL

SEQ ID NO: 758310 - protein, 347 aa, Homo sapiens; identical to SEQ ID NO: 758306

SEQ ID NO: 758311 - protein, 86 aa, Homo sapiens; identical to SEQ ID NO: 758304

SEQ ID NO: 758312 - protein, 86 aa, Homo sapiens; identical to SEQ ID NO: 758304

SEQ ID NO: 758313 - protein, 122 aa, Homo sapiens
MWYRTRPAASLERGNITLLLTITDRTTKQPCKLILEDLKENPLITEWHSQLAGSETPLSHATCMENDFWSVILSKEKQSKFSTFKIKGHSVYIKTSRYKEVSYCWIKNIQDNGHNLKAHGKT

SEQ ID NO: 758314 - protein, 122 aa, Homo sapiens; identical to SEQ ID NO: 758313

SEQ ID NO: 758315 - protein, 81 aa, Homo sapiens
CPRTKFWTRNHDSKFMFWVCRSLANDFARSELVRGLGFLVSEVNACKVLSSLRIWTLPVHLTGLFKMKNSEHVMFYVEKYT

SEQ ID NO: 758316 - protein, 697 aa, Homo sapiens
GPDSRAAGARVGGWGCPQGLASGVLGGQWVQGVWFVSAGRQANATHAVGEAASVVDRAAWPCGSRAMVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 758317 - protein, 608 aa, Homo sapiens
GPDSRAAGARVGGWGCPQGLASGVLGGQWVQGVWFVSAGRQANATHAVGEAASVVDRAAWPCGSRAMVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHGERPVPHTAGDDDRGWLSMDAGERGAWQALQSACVSGTSVFP

SEQ ID NO: 758318 - protein, 1508 aa, Homo sapiens
MGQEPRTLPPSPNWYCARCSDAVPGGLFGFAARTSVFLVRVGPGAGESPGTPPFRVIGELVGHTERVSGFTFSHHPGQYNLCATSSDDGTVKIWDVETKTVVTEHALHQHTISTLHWSPRVKDLIVSGDEKGVVFCYWFNRNDSQHLFIEPRTIFCLTCSPHHEDLVAIGYKDGIVVIIDISKKGEVIHRLRGHDDEIHSIAWCPLPGEDCLSINQEETSEEAEITNGNAVAQAPVTKGCYLATGSKDQTIRIWSCSRGRGVMILKLPFLKRRGGGIDPTVKERLWLTLHWPSNQPTQLVSSCFGGELLQWDLTQSWRRKYTLFSASSEGQNHSRIVFNLCPLQTEDDKQLLLSTSMDRDVKCWDIATLECSWTLPSLGGFAYSLAFSSVDIGSLAIGVGDGMIRVWNTLSIKNNYDVKNFWQGVKSKVTALCWHPTKEGCLAFGTDDGKVGLYDTYSNKPPQISSTYHKKTVYTLAWGPPVPPMSLGGEGDRPSLALYSCGGEGIVLQHNPWKLSGEAFDINKLIRDTNSIKYKLPVHTEISWKADGKIMALGNEDGSIEIFQIPNLKLICTIQQHHKLVNTISWHHEHGSQPELSYLMASGSNNAVIYVHNLKTVIESSPESPVTITEPYRTLSGHTAKITSVAWSPHHDGRLVSASYDGTAQVWDALREEPLCNFRGHQGRLLCVAWSPLDPDCIYSGADDFCVHKWLTSMQDHSRPPQGKKSIELEKKRLSQPKAKPKKKKKPTLRTPVKLESIDGNEEESMKENSGPVENGVSDQEGEEQAREPELPCGLAPAVSREPVICTPVSSGFEKSKVTINNKVILLKKEPPKEKPETLIKKRKARSLLPLSTSLDHRSKEELHQDCLVLATAKHSRELNEDVSADVEERFHLGLFTDRATLYRMIDIEGKGHLENGHPELFHQLMLWKGDLKGVLQTAAERGELTDNLVAMAPAAGYHVWLWAVEAFAKQLCFQDQYVKAASHLLSIHKVYEAVELLKSNHFYREAIAIAKARLRPEDPVLKDLYLSWGTVLERDGHYAVAAKCYLGATCAYDAAKVLAKKGDAASLRTAAELAAIVGEDELSASLALRCAQELLLANNWVGAQEALQLHESLQGQRLVFCLLELLSRHLEEKQLSEGKSSSSYHTWNTGTEGPFVERVTAVWKSIFSLDTPEQYQEAFQKLQNIKYPSATNNTPAKQLLLHICHDLTLAVLSQQMASWDEAVQALLRAVVRSYDSGSFTIMQEVYSAFLPDGCDHLRDKLGDHQSPATPAFKSLEAFFLYGRLYEFWWSLSRPCPNSSVWVRAGHRTLSVEPSQQLDTASTEETDPETSQPEPNRPSELDLRLTEEGERMLSTFKELFSEKHASLQNSQRTVAEVQETLAEMIRQHQKSQLCKSTANGPDKNEPEVEAEQPLCSSQSQCKEEKNEPLSLPELTKRLTEANQRMAKFPESIKAWPFPDVLECCLVLLLIRSHFPGCLAQEMQQQAQELLQKYGNTKTYRRHCQTFCM

SEQ ID NO: 758319 - protein, 1508 aa, Homo sapiens; identical to SEQ ID NO: 758318

SEQ ID NO: 758320 - protein, 1508 aa, Homo sapiens; identical to SEQ ID NO: 758318

SEQ ID NO: 758321 - protein, 1421 aa, Homo sapiens
MGQEPRTLPPSPNWYCARCSDAVPGGLFGFAARTSVFLVRVGPGAGESPGTPPFRVIGELVGHTERVSGFTFSHHPGQYNLCATSSDDGTVKIWDVETKTVVTEHALHQHTISTLHWSPRVKDLIVSGDEKGVVFCYWFNRNDSQHLFIEPRTIFCLTCSPHHEDLVAIGYKDGIVVIIDISKKGEVIHRLRGHDDEIHSIAWCPLPGEDCLSINQEETSEEAEITNGNAVAQAPVTKGCYLATGSKDQTIRIWSCSRGRGVMILKLPFLKRRGGGIDPTVKERLWLTLHWPSNQPTQLVSSCFGGELLQWDLTQSWRRKYTLFSASSEGQNHSRIVFNLCPLQTEDDKQLLLSTSMDRDVKCWDIATLECSWTLPSLGGFAYSLAFSSVDIGSLAIGVGDGMIRVWNTLSIKNNYDVKNFWQGVKSKVTALCWHPTKEGCLAFGTDDGKVGLYDTYSNKPPQISSTYHKKTVYTLAWGPPVPPMSLGGEGDRPSLALYSCGGEGIVLQHNPWKLSGEAFDINKLIRDTNSIKYKLPVHTEISWKADGKIMALGNEDGSIEIFQIPNLKLICTIQQHHKLVNTISWHHEHGSQPELSYLMASGSNNAVIYVHNLKTVIESSPESPVTITEPYRTLSGHTAKITSVAWSPHHDGRLVSASYDGTAQVWDALREEPLCNFRGHQGRLLCVAWSPLDPDCIYSGADDFCVHKWLTSMQDHSRPPQGKKSIELEKKRLSQPKAKPKKKKKPTLRTPVKLESIDGNEEESMKENSGPVENGVSDQEGEEQAREPELPCGLAPAVSREPVICTPVSSGFEKSKVTINNKVILLKKEPPKEKPETLIKKRKARSLLPLSTSLDHRSKEELHQDCLVLATAKHSRELNEDVSADVEERFHLGLFTDRATLYRMIDIEGKGHLENGHPELFHQLMLWKGDLKGVLQTAAERGELTDNLVAMAPAAGYHVWLWAVEAFAKQLCFQDQYVKAASHLLSIHKVYEAVELLKSNHFYREAIAIAKARLRPEDPVLKDLYLSWGTVLERDGHYAVAAKCYLGATCAYDAAKVLAKKGDAASLRTAAELAAIVGEDELSASLALRCAQELLLANNWVGAQEALQLHESLQGQRLVFCLLELLSRHLEEKQLSEGKSSSSYHTWNTGTEGPFVERVTAVWKSIFSLDTPEQYQEAFQKLQNIKYPSATNNTPAKQLLLHICHDLTLAVLSQQMASWDEAVQALLRAVVRSYDSGSFTIMQEVYSAFLPDGCDHLRDKLGDHQSPATPAFKSLEAFFLYGRLYEFWWSLSRPCPNSSVWVRAGHRTLSVEPSQQLDTASTEETDPETSQPEPNRPSELDLRLTEEGERMLSTFKELFSEKHASLQNSQRTVAEVQETLAEMIRQHQKSQLCKSTANGPDKNEPEVEAEQPLCSSQSQW

SEQ ID NO: 758322 - protein, 77 aa, Homo sapiens
KMSFRPCAFGFRCGMLSGKSPCAISEDIKVDCFVWHGLLWIQTASIQGQMTFVCTSGSLPCKIIPGLLKVSQNLELI

SEQ ID NO: 758323 - protein, 1508 aa, Homo sapiens; identical to SEQ ID NO: 758318

SEQ ID NO: 758324 - protein, 800 aa, Homo sapiens
MMEGWYLLPMMVQPSKKSIELEKKRLSQPKAKPKKKKKPTLRTPVKLESIDGNEEESMKENSGPVENGVSDQEGEEQAREPELPCGLAPAVSREPVICTPVSSGFEKSKVTINNKVILLKKEPPKEKPETLIKKRKARSLLPLSTSLDHRSKEELHQDCLVLATAKHSRELNEDVSADVEERFHLGLFTDRATLYRMIDIEGKGHLENGHPELFHQLMLWKGDLKGVLQTAAERGELTDNLVAMAPAAGYHVWLWAVEAFAKQLCFQDQYVKAASHLLSIHKVYEAVELLKSNHFYREAIAIAKARLRPEDPVLKDLYLSWGTVLERDGHYAVAAKCYLGATCAYDAAKVLAKKGDAASLRTAAELAAIVGEDELSASLALRCAQELLLANNWVGAQEALQLHESLQGQRLVFCLLELLSRHLEEKQLSEGKSSSSYHTWNTGTEGPFVERVTAVWKSIFSLDTPEQYQEAFQKLQNIKYPSATNNTPAKQLLLHICHDLTLAVLSQQMASWDEAVQALLRAVVRSYDSGSFTIMQEVYSAFLPDGCDHLRDKLGDHQSPATPAFKSLEAFFLYGRLYEFWWSLSRPCPNSSVWVRAGHRTLSVEPSQQLDTASTEETDPETSQPEPNRPSELDLRLTEEGERMLSTFKELFSEKHASLQNSQRTVAEVQETLAEMIRQHQKSQLCKSTANGPDKNEPEVEAEQPLCSSQSQCKEEKNEPLSLPELTKRLTEANQRMAKFPESIKAWPFPDVLECCLVLLLIRSHFPGCLAQEMQQQAQELLQKYGNTKTYRRHCQTFCM

SEQ ID NO: 758325 - protein, 416 aa, Homo sapiens
AGPHQQSHQESTRGRSAGRSGRSGSFLYQVSTHEQSESAHGRTGTSTGGRQGSHHKQARDSSRHSTSQEGQDTIHGHPGSSSGGRQGSHYEQLVDRSGHSGSHHSHTTSQGRSDASHGHSGSRSASRQTRNDEQSGDGSRHSGSRHHEASSRADSSGHSQVGQGQSEGPRTSRNWGSSFSQDSDSQGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQDGQDTIRGHPGSSRGGRQGYHHEH

SEQ ID NO: 758326 - protein, 162 aa, Homo sapiens
RHRLDKGRWTGQPAVQQPHRTQLPDREHQLTLIPPAPGNATAEESLQDGPDPLLQHGCWEPAQARHFSTGAIENSLRQKGLCQPTEVTSPSADQASGPVALQNSKSHLCRSQPILLPPVFISCPEQVQNRGPSMGEKSLCLQAVFFTVTSHYFCARSHFSGS

SEQ ID NO: 758327 - protein, 34 aa, Homo sapiens
PKCKTILSSQATQNQATGRSGCETLELEQEAGGV

SEQ ID NO: 758328 - protein, 148 aa, Homo sapiens
MESRSGAQVGVQWRDLGSLQLSSPRFKRLSCLSLLSSWYYRCPPPQPANFCVFTRDRVSLYWPGRSRTPDLRHSARLGLPKCRDYRCEPPCPAIRLLFMFAAPWGNAMATALAIQGSRACGLCVSVCVYTYSCPPAAFQVTLSHPKPC

SEQ ID NO: 758329 - protein, 242 aa, Homo sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 758330 - protein, 167 aa, Homo sapiens
MDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 758331 - protein, 277 aa, Homo sapiens
ADSSSTGASGLETAGGCPGTGKRALVPEGRWLRARSLKASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 758332 - protein, 242 aa, Homo sapiens; identical to SEQ ID NO: 758329

SEQ ID NO: 758333 - protein, 164 aa, Homo sapiens
MGEASPPAPARRHLLVLLLLLSTLVIPSAAAPIHDADAQESSLGLTGLQSLLQGFSRLFLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 758334 - protein, 211 aa, Homo sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 758335 - protein, 124 aa, Homo sapiens
QAGKGEVFRRAAFEDTPAYGWEEGGPPGNPIPVRSPTSTSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 758336 - protein, 126 aa, Homo sapiens
AGGCEASSVGTMATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMVRIIYFKITYL

SEQ ID NO: 758337 - protein, 1006 aa, Homo sapiens
AGGCEASSVGTMATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 758338 - protein, 467 aa, Homo sapiens
AGGCEASSVGTMATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQGNLQGKAFQIYEKFNQKTFKSKARWLT

SEQ ID NO: 758339 - protein, 149 aa, Homo sapiens
AGGCEASSVGTMATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILGKN

SEQ ID NO: 758340 - protein, 1006 aa, Homo sapiens; identical to SEQ ID NO: 758337

SEQ ID NO: 758341 - protein, 394 aa, Homo sapiens
MPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 758342 - protein, 136 aa, Homo sapiens; identical to SEQ ID NO: 741065

SEQ ID NO: 758343 - protein, 136 aa, Homo sapiens; identical to SEQ ID NO: 741065

SEQ ID NO: 758344 - protein, 136 aa, Homo sapiens; identical to SEQ ID NO: 741065

SEQ ID NO: 758345 - protein, 126 aa, Homo sapiens
RTATPLSGTAAMNAFLLSALCLLGAWAALAGGVTVQDGNFSFSLESVKKLKDLQEPQEPRVGKLRNFAPIPGEPVVPILCSNPNFPEELKPLCKEPNAQEILQRLEEIAEDPGTCEICAYAACTGC

SEQ ID NO: 758346 - protein, 515 aa, Homo sapiens
MAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 758347 - protein, 677 aa, Homo sapiens
APSLRRGREPSERRAPAPRGPSATSLRWPSKVRRPTMPPPPPLLLLTVLVVAAARPGCEFERNPAATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 758348 - protein, 688 aa, Homo sapiens
APSLRRGREPSERRAPAPRGPSATSLRWPSKVRRPTMPPPPPLLLLTVLVVAAARPGCEFERNPAGECHRPPAADSATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 758349 - protein, 523 aa, Homo sapiens
MAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAESGVGHVLQGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 758350 - protein, 523 aa, Homo sapiens; identical to SEQ ID NO: 758349

SEQ ID NO: 758351 - protein, 523 aa, Homo sapiens; identical to SEQ ID NO: 758349

SEQ ID NO: 758352 - protein, 724 aa, Homo sapiens
APSLRRGREPSERRAPAPRGPSATSLRWPSKVRRPTMPPPPPLLLLTVLVVAAARPGCEFERNPAGECHRPPAADSATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKKGAPSSAQTCPAWWGPDELMQGEPFACLTHQEPLPKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 758353 - protein, 688 aa, Homo sapiens; identical to SEQ ID NO: 758348

SEQ ID NO: 758354 - protein, 86 aa, Homo sapiens
MSDFNYLHTNCFEITVELGCVKFPPEEALYTLWQHNKESLLNFVETVSSDGLRALVQLWPGWGGSHSGPQGSPRSLTAPYTHAPFA

SEQ ID NO: 758355 - protein, 109 aa, Homo sapiens
PRESGRSRIRSVANQVAGDMLPNSTERAITIAGVPQSVTECVKQICLVMLETLSQSPQGRVMTIPYQPMPASSPVICAGGQDRCSGPRYPAILSSYSGTVADTKLVSLV

SEQ ID NO: 758356 - protein, 387 aa, Homo sapiens
MTLVRRCPRRVVDQRRDTYRAQSNGPARELAMDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758357 - protein, 356 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758358 - protein, 324 aa, Homo sapiens
SVRRTFSREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758359 - protein, 283 aa, Homo sapiens
MIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758360 - protein, 283 aa, Homo sapiens; identical to SEQ ID NO: 758359

SEQ ID NO: 758361 - protein, 250 aa, Homo sapiens
TSDSGRNGWCGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758362 - protein, 243 aa, Homo sapiens
QHIPATWTCARSVELGSISPAPGPAPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758363 - protein, 356 aa, Homo sapiens; identical to SEQ ID NO: 758357

SEQ ID NO: 758364 - protein, 356 aa, Homo sapiens; identical to SEQ ID NO: 758357

SEQ ID NO: 758365 - protein, 215 aa, Homo sapiens
MDAGVTESGLNVTLTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758366 - protein, 107 aa, Homo sapiens
MMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758367 - protein, 208 aa, Homo sapiens
ASSPDDLRELAGMGWYGMVMTLPCGDWESVSSMTRKSVPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758368 - protein, 204 aa, Homo sapiens
ASSPRSSAGAGRHGLVRNGHDSPLRRLGERLQHDQANLLDTLGDRLRHASDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758369 - protein, 356 aa, Homo sapiens; identical to SEQ ID NO: 758357

SEQ ID NO: 758370 - protein, 339 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758371 - protein, 156 aa, Homo sapiens
CRTAQIPSGQLGWEVGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758372 - protein, 183 aa, Homo sapiens
MYTWQVNLCCLYSDLELAYLAQRLICLFLTSMLDVAIEKFSAAPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758373 - protein, 406 aa, Homo sapiens
EAAGSGEGGGGGPATTLRPPARSRSLPRPSLASRRQFWAYTSPPPASRQRLDHVMRVLIAASVMDLAMDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 758374 - protein, 356 aa, Homo sapiens; identical to SEQ ID NO: 758357

SEQ ID NO: 758375 - protein, 356 aa, Homo sapiens; identical to SEQ ID NO: 758357

SEQ ID NO: 758376 - protein, 338 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQISAASISLAQYLINARLSSEKGMGCS

SEQ ID NO: 758377 - protein, 356 aa, Homo sapiens; identical to SEQ ID NO: 758357

SEQ ID NO: 758378 - protein, 304 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGLIEGTELDSYSH

SEQ ID NO: 758379 - protein, 205 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCTRTV

SEQ ID NO: 758380 - protein, 223 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPRYSALPSWLPSSTNTISQGSPRRPAPPHRDDRADVACS

SEQ ID NO: 758381 - protein, 87 aa, Homo sapiens
MDAGVTESGLNVTLTIRLLMHGKEVGSIIGKKGESVKRIREESGARINISEGNCPERIITLTGPTNAIFKAFAMIIDKLVWPRGPGS

SEQ ID NO: 758382 - protein, 412 aa, Homo sapiens
GSGACGGSGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGKKKKKKKKKKKTNQRGGLIMTTSEGEIKARQNISRTQGGPQIEPTPKRPPPPERAAQKTHESRKEEKQTATRGPETKRPTTHARSHTLGAPPTETTKHTQEANIRTTEAIVRAQQKDRPRTNKHNNTKTTKRTTINHGRNQSKIRGENHANTQHEHKQPNRRRKHSETHSNKKETTTKKPERQRRAEQEDLASAGEQREGAERSNETSERTTRGAPQGDRTQKYCDARETNTQARERTARRRARRDVTR

SEQ ID NO: 758383 - protein, 356 aa, Homo sapiens; identical to SEQ ID NO: 758357

SEQ ID NO: 758384 - protein, 112 aa, Homo sapiens
TLCGLSCAVFFMYFVFRSGCFVFGCWVFVLFVLCPPLVLFLVFLVWISCRVCCSRICVVFFFLFAAFVFFFVFFCLAFVVSRVLGSVSWLVSVCACDFGVLSLGLCWSSVGS

SEQ ID NO: 758385 - protein, 90 aa, Homo sapiens
KQWYQRRGPITAGERVGTSGFGAGVFVVPATKERELNMGDVEKGKKIFIMKCSQCHTVEKGGKHKTGPNLHGLLWAEDRSGPWILLHSRQ

SEQ ID NO: 758386 - protein, 103 aa, Homo sapiens
TSGRGSAERVWLHLHRYLSADRRVLGLREWGRPASERECSLCQRLKREVRAGRGGRTWLEAELWEARTCERPKPKRGAFEWSPRWVGGRGVKTLDCGQTELGE

SEQ ID NO: 758387 - protein, 102 aa, Homo sapiens
MVSCGRKTGQAPGYSYTAANKNKEGHPILGGRKGITTGIGKVNFGKNSHKKGYLSWVTNNTCTPQARADYKATEREKNKGADLTLTPLFLRQKRSNLTWTLT

SEQ ID NO: 758388 - protein, 370 aa, Homo sapiens
MPTETLQTGSMVKPVSPAGTFTSAVPLRILNKGPDYFRRQAEPNPKRLSAVERLEADKAKYVKSQEVINAKQEPVKPAVLAKPPVCPAAKRALGSPTLKVFGNHAKTESGVQRENLKLEILKNIINSSEGSSSGSGHKHSSRNWPPHRSEATDLHRHSFAESLKVYPTQGRRSPQEGGSHVGRRLLEQSAESFLHVSHSSSDIRKVTSVKPLKAIPCSSSAPPLPPKPKIAAIASMKSPEADPVEPACGVSRRPSLQRSKSDLSDRYFRVDADVERFFNYCGLDPEELENLGMENFARANSDIISLNFRSASMISSDCEQSQDSNSDLRNDDSANDRVPYGISAIERNARIIKWLYSIKQARESQKVSHV

SEQ ID NO: 758389 - protein, 114 aa, Homo sapiens
LTLRRSLPEPSHSVQTEPSRPPPAGPFAAARPGPVPPAPSALYPRPRGGDREHSAAPTARSRPFVPRGPRLSLLAVPRSLAPGSGRTARDWGERPRNLQIGHPEQHSCSVYVLN

SEQ ID NO: 758390 - protein, 114 aa, Homo sapiens; identical to SEQ ID NO: 758389

SEQ ID NO: 758391 - protein, 370 aa, Homo sapiens; identical to SEQ ID NO: 758388

SEQ ID NO: 758392 - protein, 370 aa, Homo sapiens; identical to SEQ ID NO: 758388

SEQ ID NO: 758393 - protein, 370 aa, Homo sapiens; identical to SEQ ID NO: 758388

SEQ ID NO: 758394 - protein, 370 aa, Homo sapiens; identical to SEQ ID NO: 758388

SEQ ID NO: 758395 - protein, 370 aa, Homo sapiens; identical to SEQ ID NO: 758388

SEQ ID NO: 758396 - protein, 370 aa, Homo sapiens; identical to SEQ ID NO: 758388

SEQ ID NO: 758397 - protein, 370 aa, Homo sapiens; identical to SEQ ID NO: 758388

SEQ ID NO: 758398 - protein, 370 aa, Homo sapiens; identical to SEQ ID NO: 758388

SEQ ID NO: 758399 - protein, 164 aa, Homo sapiens
QQEKFGQEGAVGADQASSGNTQGSATLDSSSPLGGSASLFPPGTKTQPGHSQGFRENKHCVWGVKKGQVLGMWLQACLTGQRQPPQPRTGLPITLFCLECPCAGLPPATSPLQKNRDAFLELPLSIPPSKSGTDGVAGVGSILICFLSLLPLCPDIKTWESCLF

SEQ ID NO: 758400 - protein, 260 aa, Homo sapiens
KDAVEKKLEAFPLGTEVGTDIYADDETVRNLQEQLQLANQEKTQAVELWQTVSQELDRLHKLYQEHMTEAQIHVFESQKQKDQLFDFQQLTKQLHVTNENMEVTNQQFLKTVTEQSVIIEQLRKKLRQAKLELRVAVAKVEELTNVTEDLQGQMKKKEKDVVSAHGREEASDRRLQQLQSSIKQLEIRLCVTIQEANQLRTENTHLEKQTRELQAKCNELENERYEAIVRARNSMQLLEEANLQKSQALLEEKQKEEDIE

SEQ ID NO: 758401 - protein, 256 aa, Homo sapiens
MPREDRATWKSNYFLKIIQLLDDYPKCFIVGADNVGSKQMQQIRMSLRGKNNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDKTEETLHSRFLEGVRNVASVCLQTGYPTVASVPHSIINGYKRVLALSVETDYTFPLAENVKAFLADPSAFV

SEQ ID NO: 758402 - protein, 276 aa, Homo sapiens
MPREDRATWKSNYFLKIIQLLDDYPKCFIVGADNVGSKQMQQIRMSLRGKVVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDKTEETLHSRFLEGVRNVASVCLQTGYPTVASVPHSIINGYKRVLALSVETDYTFPLAENVKAFLADPSAFV

SEQ ID NO: 758403 - protein, 276 aa, Homo sapiens
MPREDRATWKSNYFLKIIQLLDDYPKCFIVGADNVGSKQMQQIRMSLRGKVVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNWQHLQPEVLDKTEETLHSRFLEGVRNVASVCLQTGYPTVASVPHSIINGYKRVLALSVETDYTFPLAENVKAFLADPSAFV

SEQ ID NO: 758404 - protein, 1690 aa, Homo sapiens
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRGDPGSYGSPGFPGLKGELGLVGDPGLFGLIGPKGDPGNRGHPGPPGVLVTPPLPLKGPPGDPGFPGRYGETGDVGPPGPPGLLGRPGEACAGMIGPPGPQGFPGLPGLPGEAGIPGRPDSAPGKPGKPGSPGLPGAPGLQGLPGSSVIYCSVGNPGPQGIKGKVGPPGGRGPKGEKGNEGLCACEPGPMGPPGPPGLPGRQGSKGDLGLPGWLGTKGDPGPPGAEGPPGLPGKHGASGPPGNKGAKGDMVVSRVKGHKGERGPDGPPGFPGQPGSHGRDGHAGEKGDPGPPGDHEDATPGGKGFPGPLGPPGKAGPVGPPGLGFPGPPGERGHPGVPGHPGVRGPDGLKGQKGDTISCNVTYPGRHGPPGFDGPPGPKGFPGPQGAPGLSGSDGHKGRPGTPGTAEIPGPPGFRGDMGDPGFGGEKGSSPVGPPGPPGSPGVNGQKGIPGDPAFGHLGPPGKRGLSGVPGIKGPRGDPGCPGAEGPAGIPGFLGLKGPKGREGHAGFPGVPGPPGHSCERGAPGIPGQPGLPGYPGSPGAPGGKGQPGDVGPPGPAGMKGLPGLPGRPGAHGPPGLPGIPGPFGDDGLPGPPGPKGPRGLPGFPGFPGERGKPGAEGCPGAKGEPGEKGMSGLPGDRGLRGAKGAIGPPGDEGEMAIISQKGTPGEPGPPGDDGFPGERGDKGTPGMQGRRGELGRYGPPGFHRGEPGEKGQPGPPGPPGPPGSTGLRGFIGFPGLPGDQGEPGSPGPPGFSGIDGARGPKGNKGDPASHFGPPGPKGEPGSPGCPGHFGASGEQGLPGIQGPRGSPGRPGPPGSSGPPGCPGDHGMPGLRGQPGEMGDPGPRGLQGDPGIPGPPGIKGPSGSPGLNGLHGLKGQKGTKGASGLHDVGPPGPVGIPGLKGERGDPGSPGISPPGPRGKKGPPGPPGSSGPPGPAGATGRAPKDIPDPGPPGDQGPPGPDGPRGAPGPPGLPGSVDLLRGEPGDCGLPGPPGPPGPPGPPGYKGFPGCDGKDGQKGPMGFPGPQGPHGFPGPPGEKGLPGPPGRKGPTGLPGPRGEPGPPADVDDCPRIPGLPGAPGMRGPEGAMGLPGMRGPPGPGCKGEPGLDGRRGVDGVPGSPGPPGRKGDTGEDGYPGGPGPPGPIGDPGPKGFGPGYLGGFLLVLHSQTDQEPTCPLGMPRLWTGYSLLYLEGQEKAHNQDLGLAGSCLPVFSTLPFAYCNIHQVCHYAQRNDRSYWLASAAPLPMMPLSEEAIRPYVSRCAVCEAPAQAVAVHSQDQSIPPCPQTWRSLWIGYSFLMHTGAGDQGGGQALMSPGSCLEDFRAAPFLECQGRQGTCHFFANKYSFWLTTVKADLQFSSAPAPDTLKESQAQRQKISRCQVCVKYS

SEQ ID NO: 758405 - protein, 316 aa, Homo sapiens
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRVSIICC

SEQ ID NO: 758406 - protein, 121 aa, Homo sapiens
RSYWLASAAPLPMMPLSEEAIRPYVSRCAVCEAPAQAVAVHSQDQSIPPCPQTWRSLWIGYSFLMVSPVPLKTLAHSPFPNTFSRHFSLDWTVILSTLRLGHKVTGTVANHSLLGCRAIIF

SEQ ID NO: 758407 - protein, 123 aa, Homo sapiens
FQNTYLQRPDGGRKGLGTPTWGVWTRGVSSSLPKGLAGSCLPVFSTLPFAYCNIHQVCHYAQRNDRSYWLASAAPLPMMPLSEEAIRPYVSRCAVCEAPAQAVAVHSQDQSIPPCPQTWRSLW

SEQ ID NO: 758408 - protein, 326 aa, Homo sapiens
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQIFDFSLTEEEMKDIEALNKNVRFVELLMWRDHPEYPFHDEY

SEQ ID NO: 758409 - protein, 194 aa, Homo sapiens
MVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQVARSS

SEQ ID NO: 758410 - protein, 194 aa, Homo sapiens; identical to SEQ ID NO: 758409

SEQ ID NO: 758411 - protein, 220 aa, Homo sapiens
MGPTSTVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQVARSS

SEQ ID NO: 758412 - protein, 64 aa, Homo sapiens
GQGRQCTRGSASTGQSWVRGPPDAGGKLETPQEPGLASFLIPCTCDGQQRPPVPTGQFQAGPRD

SEQ ID NO: 758413 - protein, 484 aa, Homo sapiens
VSWAPGSRRDRTRRVAAWPGVDAVAEPARRWKRVAERRDLGGLAMEEEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEVASAASDGLLRLDLDVPDSGPPVFAPSNHVSEAQPRETPRPLMPPTKPFLAPETTSPGDRVETPVGERAPTPVSASSEVSPESQEDSETPAEEDSGSEQPPNSVLPDKLKVSWENPSPQEAPAAESAEPSQAPCSETSEAAPREGGKPPKPPPKILSEKLKASMGEMQASGPPAPGTVQVSVNGMDDSPEPAKPSQAEGTPGTPPKDATTSTALPPWDLPPQFHPRCSSLGDLLGEGPRHPLQPRERLYRAQLEVKVASEQTEKLLNKVLGSEPAPVSAETLLSQAVEQLRQATQVLQEMRDLGELSQEAPGLREKRKELVTLYRRSAP

SEQ ID NO: 758414 - protein, 132 aa, Homo sapiens
WEEGEHQARNHVGRVALHWAAGAGHEQAVRLLLEHEAAVDEEDAVGALTEEGNTALHLAAGRGHMAVLQRLVDIGLDLEEQNAEGLTALHSAAGGSHPDCVQLLLRAGSTVNALTQVARPSQDCGRLLAAEP

SEQ ID NO: 758415 - protein, 534 aa, Homo sapiens
VSWAPGSRRDRTRRVAAWPGVDAVAEPARRWKRVAERRDLGGLAMEEEGVKEAGEKPRGAQMVDKAGWIKKSSGGLLGFWKDRYLLLCQAQLLVYENEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEVASAASDGLLRLDLDVPDSGPPVFAPSNHVSEAQPRETPRPLMPPTKPFLAPETTSPGDRVETPVGERAPTPVSASSEVSPESQEDSETPAEEDSGSEQPPNSVLPDKLKVSWENPSPQEAPAAESAEPSQAPCSETSEAAPREGGKPPKPPPKILSEKLKASMGEMQASGPPAPGTVQVSVNGMDDSPEPAKPSQAEGTPGTPPKDATTSTALPPWDLPPQFHPRCSSLGDLLGEGPRHPLQPRERLYRAQLEVKVASEQTEKLLNKVLGSEPAPVSAETLLSQAVEQLRQATQVLQEMRDLGELSQEAPGLREKRKELVTLYRRSAP

SEQ ID NO: 758416 - protein, 274 aa, Homo sapiens
VSWAPGSRRDRTRRVAAWPGVDAVAEPARRWKRVAERRDLGGLAMEEEGVKEAGEKPRGAQMVDKAPAAESAEPSQAPCSETSEAAPREGGKPPKPPPKILSEKLKASMGEMQASGPPAPGTVQVSVNGMDDSPEPAKPSQAEGTPGTPPKDATTSTALPPWDLPPQFHPRCSSLGDLLGEGPRHPLQPRERLYRAQLEVKVASEQTEKLLNKVLGSEPAPVSAETLLSQAVEQLRQATQVLQEMRDLGELSQEAPGLREKRKELVTLYRRSAP

SEQ ID NO: 758417 - protein, 534 aa, Homo sapiens; identical to SEQ ID NO: 758415

SEQ ID NO: 758418 - protein, 534 aa, Homo sapiens; identical to SEQ ID NO: 758415

SEQ ID NO: 758419 - protein, 320 aa, Homo sapiens
VSWAPGSRRDRTRRVAAWPGVDAVAEPARRWKRVAERRDLGGLAMEEEGVKEAGEKPRGAQMVDKAGWIKKSSGGLLGFWKDRYLLLCQAQLLVYENEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEFGMNALLLSAWFGHLRILQILVNSGAKIHCESKEGNTALHLAAGRGHMAVLQRLVDIGLDLEEQNAEGLTALHSAAGGSHPDCVQLLLRAGSTVNALTQVARPSQDCGRLLAAEP

SEQ ID NO: 758420 - protein, 388 aa, Homo sapiens
VSWAPGSRRDRTRRVAAWPGVDAVAEPARRWKRVAERRDLGGLAMEEEGVKEAGEKPRGAQMVDKAGWIKKSSGGLLGFWKDRYLLLCQAQLLVYENEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEFGMNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQVARPSQDCGRLLAAEP

SEQ ID NO: 758421 - protein, 437 aa, Homo sapiens
VSWAPGSRRDRTRRVAAWPGVDAVAEPARRWKRVAERRDLGGLAMEEEGVKEAGEKPRGAQMVDKAGWIKKSSGGLLGFWKDRYLLLCQAQLLVYENEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEFGMNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVD

SEQ ID NO: 758422 - protein, 81 aa, Homo sapiens
EVVSEDDRAGSNCSRVMMLGCVEEAPGVREGDSGGLSSAVMGTACAQAQHTWGLPQALEGTEQGSTRNAPFSQFIPTEIRG
